(12) United States Patent
Guan et al.

(10) Patent No.: US 7,361,747 B2
(45) Date of Patent: Apr. 22, 2008

(54) ISOLATION AND CHARACTERIZATION OF THE PRECURSOR VIRUS OF HUMAN SARS VIRUS: SARS-ASSOCIATED CORONA VIRUS-LIKE VIRUS

(75) Inventors: Yi Guan, Hong Kong (CN); Bo-Jiang Zheng, Hong Kong (CN)

(73) Assignee: The University of Hong Kong, Hong Kong (CN)

( * ) Notice: Subject to any disclaimer, the term of this patent is extended or adjusted under 35 U.S.C. 154(b) by 506 days.

(21) Appl. No.: 10/852,357

(22) Filed: May 24, 2004

(65) Prior Publication Data

US 2008/0069839 A1    Mar. 20, 2008

Related U.S. Application Data

(60) Provisional application No. 60/473,255, filed on May 22, 2003.

(51) Int. Cl.
*C07H 21/02*    (2006.01)
*C07H 19/00*    (2006.01)
(52) U.S. Cl. .................................. 536/23.1; 536/23.72
(58) Field of Classification Search ...................... None
See application file for complete search history.

(56) References Cited

U.S. PATENT DOCUMENTS

2005/0100885 A1* 5/2005 Crooke et al. ................. 435/5

FOREIGN PATENT DOCUMENTS

WO    WO 200166689 A2 *    9/2001

* cited by examiner

*Primary Examiner*—Bruce R. Campell
*Assistant Examiner*—Louise Humphrey
(74) *Attorney, Agent, or Firm*—Saliwanchik, Lloyd & Saliwanchik

(57) ABSTRACT

The present invention relates to isolation and characterization of a class of isolated novel viruses which is the precursor of the virus causing Severe Acute Respiratory Syndrome (SARS) in humans ("hSARS virus"). The precursor virus which is a SARS coronavirus-like virus ("SCoV-like virus") is identified to be morphologically and phylogenetically similar to hSARS virus. The present invention relates to a nucleotide sequence comprising the genomic sequence of the SCoV-like virus. The invention further relates to nucleotide sequences comprising a portion of the genomic sequence of the SCoV-like virus. The invention also relates to the deduced amino acid sequences of the SCoV-like virus. The invention further relates to the nucleic acids and peptides encoded by and/or derived from these sequences and their use in diagnostic methods and therapeutic methods. The invention further encompasses chimeric or recombinant viruses encoded by said nucleotide sequences and antibodies directed against polypeptides encoded by the nucleotide sequences. Furthermore, the invention relates to vaccine preparations comprising the SCoV-like virus, including recombinant and chimeric forms of said virus.

5 Claims, 82 Drawing Sheets

5'-CCTACTGGTTACCAACCTGAATGGAATAT-3'

FIG. 2

```
   1 ctacccagga aaagccaacc aacctcgatc tcttgtagat ctgttctcta aacgaacttt
  61 aaaatctgtg tagctgtcgc tcggctgcat gcctagtgca cctacgcagt ataaacaata
 121 ataaatttta ctgtcgttga caagaaacga gtaactcgtc cctcttctgc agactgctta
 181 cggtttcgtc cgtgttgcag tcgatcatca gcatacctag gtttcgtccg ggtgtgaccg
 241 aaaggtaaga tggagagcct tgttcttggt gtcaacgaga aaacacacgt ccaactcagt
 301 ttgcctgtcc ttcaggttag agacgtgcta gtgcgtggct tcggggactc tgtggaagag
 361 gccctatcgg aggcacgtga acacctcaaa aatggcactt gtggtctagt agagctggaa
 421 aaaggcgtac tgccccagct tgaacagccc tatgtgttca ttaaacgttc tgatgcctta
 481 agcaccaatc acggccacaa ggtcgttgag ctggttgcag aaatggacgg cattcagtac
 541 ggtcgtagcg gtataacact gggagtactc gtgccacatg tgggcgaaac cccaattgca
 601 taccgcaatg ttcttcttcg taagaacggt aataagggag ccggtggtca tagctatggc
 661 atcgatctaa agtcttatga cttaggtgac gagcttggca ctgatcccat tgaagattat
 721 gaacaaaact ggaacactaa gcatggcagt ggtgcactcc gtgaactcac tcgtgagctc
 781 aatggaggtg cagtcactcg ctatgtcgac aacaatttct gtggcccaga tgggtaccct
 841 cttgattgca tcaaagattt tctcgcacgc gcgggcaagt caatgtgcac tctttccgaa
 901 caacttgatt acatcgagtc gaagagaggt gtctactgct gccgtgacca tgagcatgaa
 961 attgcctggt tcactgagcg ctctgataag agctacgagc accagacacc cttcgaaatt
1021 aagagtgcca agaaatttga cactttcaaa ggggaatgcc caaagttgt gtttcctctt
1081 aactcaaaag tcaaagtcat tcaaccacgt gttgaaaaga aaaagactga gggtttcatg
1141 gggcgtatac gctctgtgta ccctgttgca tctccacagg agtgtaacaa tatgcacttg
1201 tctaccttga tgaaatgtaa tcattgcgat gaagtttcat ggcagacgtg cgactttctg
1261 aaagccactt gtgaacattg tggcactgaa aatttagtta ttgaaggacc tactacatgt
1321 gggtacctac ctactaatgc tgtagtgaaa atgccatgtc ctgcctgtca agacccagag
1381 attggacctg agcatagtgt tgcagattat cacaaccact caaacattga aactcgactc
1441 cgcaagggag gtaggactag atgttttgga ggctgtgtgt ttgcctatgt tggctgctat
1501 aataagcgtg cctactgggt tcctcgtgct agtgctgata ttggctcagg ccatactggc
1561 attactggtg acaatgtgga gaccttgaat gaggatctcc ttgagatact gagtcgtgaa
1621 cgtgttaaca ttaacattgt tggcgatttt catttgaatg aagaggttgc catcattttg
1681 gcatctttct ctgcttctac aagtgccttt attgacacta taaagagtct tgattacaag
1741 tcttttcaaaa ccattgttga gtcctgcggt aactataaag ttaccaaggg aaagcccgta
1801 aaaggtgctt ggaacattgg acaacagaga tcagttttaa caccactgtg tggttttccc
1861 tcacaggctg ctggtgttat cagatcaatt tttgcgcgca cacttgatgc agcaaaccac
1921 tcaattcctg atttgcaaag agcagctgtc accatacttg atggtatttc tgaacagtca
1981 ttacgtcttg tcgacgccat ggtttatact tcagacctgc tcaccaacag tgtcattatt
2041 atggcatatg taactggtgg tcttgtacaa cagacttctc agtggttgtc taatctttg
2101 ggcactactg ttgaaaaact caggcctatc tttgaatgga ttgaggcgaa acttagtgca
2161 ggagttgaat tctcaagga tgcttgggag attctcaaat ttctcattac aggtgttttt
2221 gacatcgtca agggtcaaat acaggttgct tcagataaca tcaaggattg tgtaaaatgc
2281 ttcattgatg ttgttaacaa ggcactcgaa atgtgcattg atcaagtcac tatcgctggc
2341 gcaaagttgc gatcactcaa cttaggtgaa gtcttcatcg ctcaaagcaa gggactttac
2401 cgtcagtgta tacgtggcaa ggagcagctg caactactca tgcctcttaa ggaccaaaaa
2461 gaagtaacct ttcttgaagg tgattcacat gacacagtac ttacctctga ggaggttgtt
2521 ctcaagaacg gtgaactcga agcactcgag acgcccgttg atagcttcac aaatggagct
2581 atcgttggca caccagtctg tgtaaatggc ctcatgctct tagagattaa ggacaaagaa
2641 caatactgcg cattgtctcc tggttactg gctacaaaca atgtctttcg cttaaaaggg
2701 ggtgcaccaa ttaaaggtgt aaccttggga gaagatactg tttgggaagt tcaaggttac
2761 aagaatgtga gaatcacatt tgagcttgat gaacgtgttg acaaagtgct taatgaaaag
2821 tgctctgtct acactgttga atccggtacc gaagttactg agtttgcatg tgttgtagca
2881 gaggctgttg tgaagacttt acaaccagtt tctgatctcc ttaccaacat gggtattgat
2941 cttgatgagt ggagtgtagc tacattctac ttatttgatg atgctggtga agaaaacttt
3001 tcatcacgta tgtattgttc ctttttaccct ccagatgagg aagaagagga cgatgcagag
3061 tgtgaggaag aagaaattga tgaaacctgt gaacatgagt acggtacaga ggatgattat
3121 caaggtctcc ctctggaatt tggtgcctca gctgaaacag ttcgagttga ggaagaagaa
3181 gaggaagact ggctggatga tactactgag caatcagaga ttgagccaga accagaacct
3241 acacctgaag aaccagttaa tcagtttact ggttatttaa aacttactga caatgttgcc
```

FIG. 3

```
3301 attaaatgtg ttgacatcgt taaggaggca caaagtgcta atcctatggt gattgtaaat
3361 gctgctaaca tacacctgaa acatggtggt ggtgtagcag gtgcactcaa caaggcaacc
3421 aatggtgcca tgcaaaagga gagtgatgat tacattaagc taaatggccc tcttacagta
3481 ggagggtctt gtttgctttc tggacataat cttgctaaga agtgtctgca tgttgttgga
3541 cctaacctaa atgcaggtga ggacatccag cttcttaagg cagcatatga aaatttcaat
3601 tcacaggaca tcttacttgc accattgttg tcagcaggca tatttggtgc taaaccactt
3661 cagtctttac aagtgtgcgt gcagacggtt cgtacacagg tttatattgc agtcaatgac
3721 aaagctcttt atgagcaggt tgtcatggat tatcttgata acctgaagcc tagagtggaa
3781 gcacctaaac aagaggagcc accaaacaca gaagattcca aaactgagga gaaatctgtc
3841 gtacagaagc ctgtcgatgt gaagccaaaa attaaggcct gcattgatga ggttaccaca
3901 acactggaag aaactaagtt tcttaccaat aagttactct tgtttgctga tatcaatggt
3961 aagctttacc atgattctca gaacatgctt agaggtgaag atatgtcttt ccttgagaag
4021 gatgcacctt acatggtagg tgatgttatc actagtggtg atatcacttg tgttgtaata
4081 ccctccaaaa aggctggtgg cactactgag atgctctcaa gagctttgaa gaaagtgcca
4141 gttgatgagt atataaccac gtaccctgga caaggatgtg ctggttatac acttgaggaa
4201 gctaagactg ctcttaagaa atgcaaatct gcattttatg tactaccttc agaagcacct
4261 aatgctaagg aagagattct aggaactgta tcctggaatt tgagagaaat gcttgctcat
4321 gctgaagaga caagaaaatt aatgcctata tgcatggatg ttagagccat aatggcaacc
4381 atccaacgta agtataaagg aattaaaatt caagagggca tcgttgacta tggtgtccga
4441 ttcttctttt atactagtaa agagcctgta gcttctatta ttacgaagct gaactctcta
4501 aatgagccgc ttgtcacaat gccaattggt tatgtgacac atggttttaa tcttgaagag
4561 gctgcgcgct gtatgcgttc tcttaaagct cctgccgtag tgtcagtatc atcaccagat
4621 gctgttacta catataatgg ataccatcact tcgtcatcaa agacatctga ggagcacttt
4681 gtagaaacag tttcttttggc tggctcttac agagattggt cctattcagg acagcgtaca
4741 gagttaggtg ttgaatttct taagcgtggt gacaaaattg tgtaccacac tctggagagc
4801 cccgtcgagt ttcatcttga cggtgaggtt ctttcacttg acaaactaaa gagtctctta
4861 tccctgcggg aggttaagac tataaaagtg ttcacaactg tggacaacac taatctccac
4921 acacagcttg tggatatgtc tatgacatat ggacagcagt ttggtccaac atacttggat
4981 ggtgctgatg ttacaaaaat taaacctcat gtaaatcatg agggtaagac tttcttttgta
5041 ctacctagtg atgacacact acgtagtgaa gctttcgagt actaccatac tcttgatgag
5101 agttttcttg gtaggtacat gtctgcttta aaccacacaa agaaatggaa atttcctcaa
5161 gttggtggtt aacttcaat taaatgggct gataacaatt gttatttgtc tagtgttta
5221 ttagcacttc aacagcttga agtcaaattc aatgcaccag cacttcaaga ggcttattat
5281 agagcccgtg ctggtgatgc tgctaacttt tgtgcactca tactcgctta cagtaataaa
5341 actgttggcg agcttggtga tgtcagagaa actatgaccc atcttctaca gcatgctaat
5401 ttggaatctg caaagcgagt tcttaatgtg gtgtgtaaac attgtggtca gaaaactact
5461 accttaacgg tgtagaagc tgtgatgtat atgggtactc tatcttatga taatcttaag
5521 acaggtgttt ccattccatg tgtgtgtggt cgtgatgcta cacaatatct agtacaacaa
5581 gagtcttctt ttgttatgat gtctgcacca cctgctgagt ataaattaca gcaaggtaca
5641 ttcttatgtg cgaatgagta cactggtaac tatcagtgtg gtcattacac tcatataact
5701 gctaaggaga ccctctatcg tattgacgga gctcacctta caaagatgtc agagtacaaa
5761 ggaccagtga ctgatgtttt ctacaaggaa acatcttaca ctacaaccat caagcctgtg
5821 tcgtataaac tcgatggagt tacttacaca gagattgaac caaattgga tgggtattat
5881 aaaaaggata atgcttacta tacagagcag cctatagacc ttgtaccaac tcaaccatta
5941 ccaaatgcga gttttgataa tttcaaactc acatgttcta acacaaaatt tgctgatgat
6001 ttaaatcaaa tgacaggctt cacaaagcca gcttcacgag ctatctgt cacattcttc
6061 ccagacttga atggcgatgt agtggctatt gactatagac actattcagc gagtttcaag
6121 aaaggtgcta aattactgca taagccaatt gtttggcaca ttaaccaggc tacaaccaag
6181 acaacgttca aaccaaacac ttggtgttta cgttgtcttt ggagtacaaa gccagtagat
6241 acttcaaatt catttgaagt tctggcagta gaagacacac aaggaatgga caatcttgct
6301 tgtgaaagtc aacaacccac ctctgaagaa gtagtggaaa tcctaccat acagaaggaa
6361 gtcatagagt gtgacgtgaa aactaccgaa gttgtaggca atgtcatact taaaccatca
6421 gatgaaggtg ttaaagtaac acaagagtta ggtcatgagg atcttatggc tgcttatgtg
6481 gaaaacacaa gcattaccat taagaaacct aatgagcttt cactagcctt aggtttaaaa
6541 acaattgcca ctcatggtat tgctgcaatt aatagtgttc cttggagtaa aattttggct
```

FIG. 3 CONT'D

```
6601 tatgtcaaac cattcttagg acaagcagca attacaacat caaattgcgc taagagatta
6661 gcacaacgtg tgtttaacaa ttatatgcct tatgtgttta cattattgtt ccaattgtgt
6721 acttttacta aaagtaccaa ttctagaatt agagcttcac tacctacaac tattgctaaa
6781 aatagtgtta agagtgttgc taaattatgt ttggatgccg gcattaatta tgtgaagtca
6841 cccaaatttt ctaaattgtt cacaatcgct atgtggctat tgttgttaag tatttgctta
6901 ggttctctaa tctgtgtaac tgctgctttt ggtgtactct tatctaattt tggtgctcct
6961 tcttattgta atggcgttag agaattgtat cttaattcgt ctaacgttac tactatggat
7021 ttctgtgaag gttcttttcc ttgcagcatt tgtttaagtg gattagactc ccttgattct
7081 tatccagctc ttgaaaccat tcaggtgacg atttcatcgt acaagctaga cttgacaatt
7141 ttaggtctgg ccgctgagtg ggttttggca tatatgttgt tcacaaaatt ctttattta
7201 ttaggtcttt cagctataat gcaggtgttc tttggctatt tgctagtca tttcatcagc
7261 aattcttggc tcatgtggtt tatcattagt attgtacaaa tggcacccgt ttctgcaatg
7321 gttaggatgt acatcttctt tgcttctttc tactacatat ggaagagcta tgttcatatc
7381 atggatggtt gcacctcttc gacttgcatg atgtgctata agcgcaatcg tgccacacgc
7441 gttgagtgta aactattgt taatggcatg aagagatctt tctatgtcta tgcaaatgga
7501 ggccgtggct ctgcaagac tcacaattgg aattgtctca attgtgacac attttgcact
7561 ggtagtacat tcattagtga tgaagttgct cgtgatttgt cactccagtt taaaagacca
7621 atcaacccta ctgaccagtc atcgtatatt gttgatagtg ttgctgtgaa aaatggcgcg
7681 cttcacctct actttgacaa ggctggtcaa aagacctatg agagacatcc tctctcccat
7741 tttgtcaatt tagacaattt gagagctaac aacactaaag gttcactgcc tattaatgtc
7801 atagttttg atggcaagtc caaatgcgac gagtctgctt ctaagtctgc ttctgtgtac
7861 tacagtcagc tgatgtgcca acctattctg ttgcttgacc aagctcttgt atcagacgtt
7921 ggagatagta ctgaagtttc cgttaagatg tttgatgctt atgtcgacac cttttcagca
7981 acttttagtg ttcctatgga aaacttaag gcacttgttg ctacagctca cagcgagtta
8041 gcaaagggtg tagctttaga tggtgtcctt tctacattcg tgtcagctgc ccgacaaggt
8101 gttgttgata ccgatgttga cacaaaggat gttattgaat gtctcaaact ttcacatcac
8161 tctgacttag aagtgacagg tgacagttgt aacaatttca tgctcaccta ataaggtt
8221 gaaaacatga cgcccagaga tcttggcgca tgtattgact gtaatgcaag gcatatcaat
8281 gcccaagtag caaaaagtca caatgtttca ctcatctgga atgtaaaga ctacatgtct
8341 ttatctgaac agctgcgtaa acaaattcgt agtgctgcca agaagaacaa catacctttt
8401 agactaactt gtgctacaac tagacaggtt gtcaatgtca taactactaa aatctcactc
8461 aagggtggta agattgttag tacttgttt aaacttatgc ttaaggccac attattgtgc
8521 gttcttctg cattggtttg ttatatcgtt atgccagtac atacattgtc aatccatgat
8581 ggttacacaa atgaaatcat tggttacaaa gccattcagg atggtgtcac tcgtgacatc
8641 atttctactg atgattgttt tgcaaataaa catgctggtt ttgacgcatg gtttagccag
8701 cgtggtggtt catacaaaaa tgacaaaagc tgccctgtag tagctgctat cattacaaga
8761 gagattggtt tcatagtgcc tggcttaccg ggtactgtgc tgagagcaat caatggtgac
8821 ttcttgcatt ttctacctcg tgtttttagt gctgttggca acatttgcta cacaccttcc
8881 aaactcattg agtatagtga ttttgctacc tctgcttgcg ttcttgctgc tgagtgtaca
8941 atttttaagg atgctatggg caaacctgtg ccatattgtt atgacactaa tttgctagag
9001 ggttctattt cttatagtga gcttcgtcca gacactcgtt atgtgcttat ggatggttcc
9061 atcatacagt ttcctaacac ttacctggag ggttctgtta gagtagtaac aactttgat
9121 gctgagtact gtagacatgg tacatgcgaa aggtcagaag taggtatttg cctatctacc
9181 agtggtagat gggttcttaa taatgagcat acagagctc tatcaggagt tttctgtggt
9241 gttgatgcga tgaatctcat agctaacatc tttactcctc ttgtgcaacc tgtgggtgct
9301 ttagatgtgt ctgcttcagt agtggctggt ggtattattg ccatattggt gacttgtgct
9361 gcctactact ttatgaaatt cagacgtgct tttggtgagt acaaccatgt tgttgctgct
9421 aatgcacttt tgtttttgat gtctttcact atactctgtc tggcaccagc ttacagcttt
9481 ctgccgggag tctactcagt cttttacttg tacttgacat ctatttcac caatgatgtt
9541 tcattcttgg ctcaccttca atggtttgcc atgtttctc ctattgtgcc ttttggata
9601 acagcaatct atgtattctg tatttctctg aagcactgcc attggttctt taacaactat
9661 cttaggaaaa gagtcatgtt taatggagtt acatttagta ccttcgagga ggctgctttg
9721 tgtaccttt tgctcaacaa ggaaatgtac ctaaaattgc gtagcgagac actgttgcca
9781 cttacacagt ataacaggta tcttgctcta tataacaagt acaagtattt cagtggagcc
9841 ttagatacta ccagctatcg tgaagcagct tgctgccact tagcaaaggc tctaaatgac
```

FIG. 3 CONT'D

```
 9901 tttagcaact caggtgctga tgttctctac caaccaccac agacatcaat cacttctgct
 9961 gttctgcaga gtggttttag gaaaatggca ttcccgtcag gcaaagttga agggtgcatg
10021 gtacaagtaa cctgtggaac tacaactctt aatggattgt ggttggatga cacagtatac
10081 tgtccaagac atgtcatttg cacagcagaa gacatgctta atcctaacta tgaagatctg
10141 ctcattcgca aatccaacca tagctttctt gttcaggctg gcaatgttca acttcgtgtt
10201 attggccatt ctatgcaaaa ttgtctgctt aggcttaaag ttgatacttc taaccctaag
10261 acacccaagt ataaatttgt ccgtatccaa cctggtcaaa cattttcagt tctagcatgc
10321 tacaatggtt caccatctgg tgtttatcag tgtgccatga gacctaatca taccattaaa
10381 ggttctttcc ttaatggatc atgtggtagt gttggtttta acattgatta tgattgcgtg
10441 tctttctgct atatgcatca tatggagctt ccaacaggag tacacgctgg tactgactta
10501 gaaggtaaat tctatggtcc atttgttgac agacaaactg cacaggctgc aggtacagac
10561 acaaccataa cattaaatgt tttggcatgg ctgtatgctg ctgttatcaa tggtgatagg
10621 tggtttctta atagattcac cactactttg aatgacttta accttgtggc aatgaagtac
10681 aactatgaac ctttgacaca agatcatgtt gacatattgg gacctctttc tgctcaaaca
10741 ggaattgccg tcttagatat gtgtgctgct ttgaaagagc tgctgcagaa tggtatgaat
10801 ggtcgtacta tccttggtag cactatttta gaagatgagt ttacaccatt tgatgttgtt
10861 agacaatgct ctggtgttac cttccaaggt aagttcaaga aaattgttaa gggcactcat
10921 cattggatgc ttttaacttt cttgacatca ctattgattc ttgttcaaag tacacagtgg
10981 tcactgtttt tctttgttta cgagaatgct ttcttgccat ttactcttgg tattatggca
11041 attgctgcat gtgctatgct gcttgttaag cataagcacg cattcttgtg cttgtttctg
11101 ttaccttctc ttgcaacagt tgcttacttt aatatggtct acatgcctgc tagctgggtg
11161 atgcgtatca tgacatggct tgaattggct gacactagct tgtctggtta taggcttaag
11221 gattgtgtta tgtatgcttc agctttagtt ttgcttattc tcatgacagc tcgcactgtt
11281 tatgatgatg ctgctagacg tgtttggaca ctgatgaatg tcattacact tgtttacaaa
11341 gtctactatg gtaatgcttt agatcaagct atttccatgt gggccttagt tatttctgta
11401 acctctaact attctggtgt cgttacgact atcatgtttt tagctagagc tatagtgttt
11461 gtgtgtgttg agtattaccc attgttattt attactggca acaccttaca gtgtatcatg
11521 cttgtttatt gtttcttagg ctattgttgc tgctgctact ttggcctttt ctgtttactc
11581 aaccgttact tcaggcttac tcttggtgtt tatgactact tggtctctac acaagaattt
11641 aggtatatga actcccaggg gcttttgcct cctaagagta gtattgatgc tttcaagctt
11701 aacattaagt tgtgggtat tggaggtaaa ccatgtatca aggttgctac tgtacagtct
11761 aaaatgtctg acgtaaagtg cacatctgtg gtactgctct cggttcttca acaacttaga
11821 gtagagtcat cttctaaatt gtgggcacaa tgtgtacaac tccacaatga tattcttctt
11881 gcaaaagaca caactgaagc tttcgagaag atggttctc ttttgtctgt tttgctatcc
11941 atgcagggtg ctgtagacat taataggttg tgcgaggaaa tgctcgataa ccgtgctact
12001 cttcaggcta ttgcttcaga atttagttct ttaccatcat atgccgctta tgccactgcc
12061 caggaggcct atgagcaggc tgtagctaat ggtgattctg aagtcgttct caaaaagtta
12121 aagaaatctt tgaatgtggc taaatctgag tttgaccgtg atgctgccat gcaacgcaag
12181 ttggaaaaga tggcagatca ggctatgacc caaatgtaca aacaggcaag atctgaggac
12241 aagagggcaa agtaactag tgctatgcaa acaatgctct tcactatgct taggaagctt
12301 gataatgatg cacttaacaa cattatcaac aatgcgcgtg atggttgtgt tccactcaac
12361 atcataccat tgactacagc agccaaactc atggttgttg ccctgatta tgtacctac
12421 aagaacactt gtgatggtaa cacctttaca tatgcatctg cactctggga atccagcaa
12481 gttgttgatg cggatagcaa gattgttcaa cttagtgaaa ttaacatgga caattcacca
12541 aatttggctt ggcctcttat tgttacagct ctaagagcca actcagctgt taaactacag
12601 aataatgaac tgagtccagt agcactacga cagatgtcct gtgcggctgg taccacacaa
12661 acagcttgta ctgatgacaa tgcacttgcc tactataaca ttcgaagggg aggtaggttt
12721 gtgctggcat tactatcaga ccaccaagat ctcaaatggg ctagattccc taagagtgat
12781 ggtacaggta caatttacac agaactggaa ccaccttgta ggtttgttac agacacacca
12841 aaagggccta agtgaaata cttgtacttc atcaaaggct taaacaacct aaatagaggt
12901 atggtgctgg gcagtttagc tgctacagta cgtcttcagg ctggaaatgc tacagaagta
12961 cctgccaatt caactgtgct ttccttctgt gcttttgcag tagaccctgc taaagcatat
13021 aaggattacc tagcaagtgg aggacaacca atcaccaact gtgtgaagat gttgtgtaca
13081 cacactggta caggacaggc aattactgta acaccagaag ctaacatgga ccaagagtcc
13141 tttggtggtg cttcatgttg tctgtattgt agatgccaca ttgaccatcc aaatcctaaa
```

```
13201 ggattctgtg acttgaaagg taagtacgtc caaataccta ccacttgtgc taatgaccca
13261 gtgggtttta cacttagaaa cacagtctgt accgtctgcg gaatgtggaa aggttatggc
13321 tgtagttgtg accaactccg cgaacccttg atgcagtctg cggatgcatc aacgttttta
13381 aacgggtttg cggtgtaagt gcagcccgtc ttacaccgtg cggcacaggc actagtactg
13441 atgtcgtcta cagggctttt gatatttaca acgaaaaagt tgctggtttt gcaaagttcc
13501 taaaaactaa ttgctgtcgc ttccaggaga aggatgagga aggcaattta ttagactctt
13561 actttgtagt taagaggcat actatgtcta actaccaaca tgaagagact atttataact
13621 tggttaaaga ttgtccagcg gttgctgtcc atgactttt caagtttaga gtagatggtg
13681 acatggtacc acatatatca cgtcagcgtc taactaaata cacaatggct gatttagtct
13741 atgctctacg tcatttgat gagggtaatt gtgatacatt aaaagaaata ctcgtcacat
13801 acaattgctg tgatgatgat tatttcaata agaaggattg gtatgacttc gtagagaatc
13861 ctgacatctt acgcgtatat gctaacttag gtgagcgtgt acgccaatca ttattaaaga
13921 ctgtacaatt ctgcgatgct atgcgtgatg caggcattgt aggcgtactg acattagata
13981 atcaggatct taatgggaac tggtacgatt tcggtgattt cgtacaagta gcaccaggct
14041 gcggagttcc tattgtggat tcatattact cattgctgat gcccatcctc actttgacta
14101 gggcattggc tgctgagtcc catatggatg ctgatctcgc aaaaccactt attaagtggg
14161 atttgctgaa atatgatttt acggaagaga ctttgtct cttcgaccgt tatttaaat
14221 atttgggacca gacataccat cccaattgta ttaactgttt ggatgatagg tgtatccttc
14281 attgtgcaaa ctttaatgtg ttatttcta ctgtgtttcc acctacaagt tttggaccac
14341 tagtaagaaa aatatttgta gatggtgttc cttttgttgt ttcaactgga taccattttc
14401 gtgagttagg agtcgtacat aatcaggatg taaacttaca tagctcgcgt ctcagtttca
14461 aggaactttt agtgtatgct gctgatccag ctatgcatgc agcttctggc aatttattgc
14521 tagataaacg cactacatgc ttttcagtag ctgcactaac aaacaatgtt gcttttcaaa
14581 ctgtcaaacc cggtaatttt aataaagact tttatgactt gctgtgtct aaaggttct
14641 ttaaggaagg aagttctgtt gaactaaaac acttcttctt tgctcaggat ggcaacgctg
14701 ctatcagtga ttatgactat tatcgttata atctgccaac aatgtgtgat atcagacaac
14761 tcctattcgt agttgaagtt gttgataaat actttgattg ttacgatggt ggctgtatta
14821 atgccaacca agtaatcgtt aacaatctgg ataaatcagc tggtttccca tttaataaat
14881 ggggtaaggc tagactttat tatgactcaa tgagttatga ggatcaagat gcacttttcg
14941 cgtatactaa gcgtaatgtc atccctacta taactcaaat gaatcttaag tatgccatta
15001 gtgcaaagaa tagagctcgc accgtagctg gtgtctctat ctgtagtact atgacaaata
15061 gacagtttca tcagaaatta ttgaagtcaa tagccgccac tagaggagct actgtggtaa
15121 ttggaacaag caagttttac ggtggctggc ataatatgtt aaaaactgtt tacagtgatg
15181 tagaaactcc acaccttatg ggttgggatt atccaaaatg tgacagagcc atgcctaaca
15241 tgcttaggat aatggcctct cttgttcttg ctcgcaaaca taacacttgc tgtaacttat
15301 cacaccgttt ctacaggtta gctaacgagt gtgcgcaagt attaagtgag atggtcatgt
15361 gtggcggctc actatatgtt aaaccaggtg gaacatcatc cggtgatgct acaactgctt
15421 atgctaatag tgtctttaac atttgtcaag ctgttacagc caatgtaaat gcacttcttt
15481 caactgatgg taataagata gctgacaagt atgtccgcaa tctacaacac aggctctatg
15541 agtgtctcta tagaaatagg gatgttgatc atgaattcgt ggatgagttt acgcttacc
15601 tgcgtaaaca tttctccatg atgattcttt ctgatgatgc cgttgtgtgc tataacagta
15661 actatgcggc tcaaggttta gtagctagca ttaagaactt taaggcagtt ctttattatc
15721 aaaataatgt gttcatgtct gaggcaaaat gttggactga gactgacctt actaaaggac
15781 ctcacgaatt ttgctcacag catacaatgc tagttaaaca aggagatgat tacgtgtacc
15841 tgccttaccc agatccatca agaatattag gcgcaggctg ttttgtcgat gatattgtca
15901 aaacagatgg tacacttatg attgaaaggt tcgtgtcact ggctattgat gcttacccac
15961 ttacaaaaca tcctaatcag gagtatgctg atgtctttca cttgtattta caatacatta
16021 gaaagttaca tgatgagctt actggccaca tgttggacat gtattccgta atgctaacta
16081 atgataacac ctcacggtac tgggaacctg agttttatga ggctatgtac acaccacata
16141 cagtcttgca ggctgtaggt gcttgtgtat tgtgcaattc acagacttca cttcgttgcg
16201 gtgcctgtat taggagacca ttcctatgtt gcaagtgctg ctatgaccat gtcatttcaa
16261 catcacacaa attagtgttg tctgttaatc cctatgtttg caatgcccca ggttgtgatg
16321 tcactgatgt gacacaactg tatctaggag gtatgagcta ttattcaag tcacataagc
16381 ctcccattag tttttccatta tgtgctaatg gtcaggtttt tggtttatac aaaaacacat
16441 gtgtaggcag tgacaatgtc actgacttca atgcgatagc aacatgtgat tggactaatg
```

FIG. 3 CONT'D

```
16501 ctggcgatta catacttgcc aacacttgta ctgagagact caagcttttc gcagcagaaa
16561 cgctcaaagc cactgaggaa acatttaagc tgtcatatgg tattgccact gtacgcgaag
16621 tactctctga cagagaattg catctttcat gggaggttgg aaaacctaga ccaccattga
16681 acagaaacta tgtctttact ggttaccgtg taactaaaaa tagtaaagta cagattggag
16741 agtcacactt tgaaaaaggt gactatggtg atgctgttgt gtacagaggt actacgacat
16801 acaagttgaa tgttggtgat tactttgtgt tgacatctca cactgtaatg ccacttagtg
16861 cacctactct agtgccacaa gagcactatg tgagaattac tggcttgtac ccaacactca
16921 acatctcaga tgagttttct agcaatgttg caaattatca aaaggtcggc atgcaaaagt
16981 actctacact ccaaggacca cctggtactg gtaagagtca ttttgccatc ggacttgctc
17041 tctattaccc atctgctcgc atagtgtata cggcatgctc tcatgcagct gttgatgccc
17101 tatgtgaaaa ggcattaaaa tatttgccca tagataaatg tagtagaatc atacctgcgc
17161 gtgcgcgcgt agagtgtttt gataaattca aagtgaattc aacactagaa cagtatgttt
17221 tctgcactgt aaatgcattg ccagaaacaa ctgctgacat tgtagtcttt gatgaaatct
17281 ctatggctac taattatgac ttgagtgttg tcaatgctag acttcgtgca aaacactacg
17341 tctatattgg cgatcctgct caattaccag ccccccgcac attgctgact aaaggcacac
17401 tagaaccaga atattttaat tcagtgtgca gacttatgaa aacaataggt ccagacatgt
17461 tccttggaac ttgtcgccgt tgtcctgctg aaattgttga cactgtgagt gctttagttt
17521 atgacaataa gctaaaagca cacaaggaga agtcagctca atgcttcaaa atgttctaca
17581 aaggtgttat tacacatgat gtttcatctg caatcaacag acctcaaata ggcgttgtaa
17641 gagaatttct tacacgcaat cctgcttgga gaaaagctgt ttttatctca ccttataatt
17701 cacagaacgc tgtagcttca aaaatcttag gattgcctac gcagactgtt gattcatcac
17761 agggttctga atatgactat gtcatattca cacaaactac tgaaacagca cactcttgta
17821 atgtcaaccg tttcaatgtg gctatcacaa gggcaaaaat tggcattttg tgcataatgt
17881 ctgatagaga tctttatgac aaactgcaat ttacaagtct agaaatacca cgtcgcaatg
17941 tggctacatt acaagcagaa aatgtaactg gacttttaa ggactgtagt aagatcatta
18001 ctggtcttca tcctacacag gcacctacac acctcagcgt tgatataaag ttcaagactg
18061 aaggattatg tgttgacata ccaggcatac caaaggacat gacctaccgt agactcatct
18121 ctatgatggg tttcaaaatg aattaccaag tcaatggtta ccctaatatg tttatcaccc
18181 gcgaagaagc tattcgtcac gttcgtgcgt ggattggctt tgatgtagag ggctgtcatg
18241 caactagaga tgctgtgggt actaacctac ctctccagct aggattttct acaggtgtta
18301 acttagtagc tgtaccgact ggttatgttg acactgaaaa taacacagaa ttcaccagag
18361 ttaatgcaaa acctccacca ggtgaccagt ttaaacatct tataccactc atgtataaag
18421 gcttgccctg gaatgtagtg cgtattaaga gtacaaaat gctcagtgat acactgaaag
18481 gattgtcaga cagagtcgtg ttcgtccttt gggcgcatgg ctttgagctt acatcaatga
18541 agtactttgt caagattgga cctgaaagaa cgtgttgtct gtgtgacaaa cgtgcaactt
18601 gcttttctac ttcatcagat acttatgcct gctggaatca ttctgtgggt tttgactatg
18661 tctataaccc atttatgatt gatgttcagc agtggggctt tacgggtaac cttcagagta
18721 accatgacca acattgccag gtacatggaa atgcacatgt ggctagttgt gatgctatca
18781 tgactagatg tttagcagtc catgagtgct tgttaagcg cgttgattgg tctgttgaat
18841 accctattat aggagatgaa ctgagggtta ttctgcttg cagaaagta caacacatgg
18901 ttgtgaagtc tgcattgctt gctgataagt ttccagttct tcatgacatt ggaaatccaa
18961 aggctatcaa gtgtgtgcct caggctgaag tagaatggaa gttctacgat gctcagccat
19021 gtagtgacaa agcttacaaa atagaggagc tcttctatc ttatgctaca catcacgata
19081 aattcactga tggtgtttgt ttgttttgga attgtaacgt tgatcgttac ccagccaatg
19141 caattgtgtg taggtttgac acaagagtct tgtcaaactt gaacttacca ggctgtgatg
19201 gtggtagttt gtatgtgaat aagcatgcat tccacactcc agcttttgat aaaagtgcat
19261 ttactaattt aaagcaattg cctttctttt actattctga tagtccttgt gagtctcatg
19321 gcaaacaagt agtgtcggat attgattatg ttccactcaa atctgctacg tgtattacac
19381 gatgcaattt aggtggtgct gtttgcagac accatgcaaa tgagtaccga cagtacttgg
19441 atgcatataa tatgatgatt tctgctggat ttagcctatg gatttacaaa caatttgata
19501 cttataacct gtggaataca tttaccaggt tacagagttt agaaaatgtg gcttataatg
19561 ttgttaataa aggacacttt gatggacacg ccggcgaagc acctgtttcc atcattaata
19621 atgctgttta cacaaaggta gatggtattg atgtggagat ctttgaaaat aagacaacac
19681 ttcctgttaa tgttgcattt gagctttggg ctaagcgtaa cattaaacca gtgccagaga
19741 ttaagatact caataatttg ggtgttgata tcgctgctaa tactgtaatc tgggactaca
```

```
19801 aaagagaagc cccagcacat gtatctacaa taggtgtctg cacaatgact gacattgcca
19861 agaaacctac tgagagtgct tgttcttcac ttactgtctt gtttgatggt agagtggaag
19921 gacaggtaga ccttttaga aacgccgta atggtgtttt aataacagaa ggttcagtca
19981 aaggtctaac accttcaaag ggaccagcac aagctagcgt caatggagtc acattaattg
20041 gagaatcagt aaaaacacag tttaactact ttaagaaagt agacggcatt attcaacagt
20101 tgcctgaaac ctactttact cagagcagag acttagagga ttttaagccc agatcacaaa
20161 tggaaactga ctttctcgag ctcgctatgg atgaattcat acagcgatat aagctcgagg
20221 gctatgcctt cgaacacatc gtttatggag atttcagtca tggacaactt ggcggtcttc
20281 atttaatgat aggcttagcc aagcgctcac aagattcacc acttaaatta gaggattta
20341 tccctatgga cagcacagtg aaaaattact tcataacaga tgcgcaaaca ggttcatcaa
20401 aatgtgtgtg ttctgtgatt gatcttttac ttgatgactt tgtcgagata ataaagtcac
20461 aagatttgtc agtgatttca aagtggtca aggttacaat tgactatgct gaaatttcat
20521 tcatgctttg gtgtaaggat ggacatgttg aaaccttcta cccaaaacta caagcaagtc
20581 aagcgtggca accaggtgtt gcgatgccta acttgtacaa gatgcaaaga atgcttcttg
20641 aaaagtgtga ccttcagaat tatggtgaaa atgctgttat accaaaagga ataatgatga
20701 atgtcgcaaa gtatactcaa ctgtgtcaat acttaaatac acttacttta gctgtaccct
20761 acaacatgag agttattcac tttggtgctg gctctgataa aggagttgca ccaggtacag
20821 ctgtgctcag acaatggttg ccaactggca cactacttgt cgattcagat cttaatgact
20881 tcgtctccga cgcagattct actttaattg gagactgtgc aacagtacat acggctaata
20941 aatgggacct tattattagc gatatgtatg accctaggac caaacatgtg acaaaagaga
21001 atgactctaa agaagggttt ttcacttatc tgtgtggatt tataaagcaa aaactagccc
21061 tgggtggttc tatagctgta aagataacag agcattcttg gaatgctgac ctttacaagc
21121 ttatgggcca tttctcatgg tggacagctt ttgttacaaa tgtaaatgca tcatcatcgg
21181 aagcatttt aattggggct aactatcttg gcaagccgaa ggaacaaatt gatggctata
21241 ccatgcatgc taactacatt ttctggagga cacaaatcc tatccagttg tcttcctatt
21301 cactctttga catgagcaaa tttcctctta aattaagagg aactgctgta atgtctctta
21361 aggagaatca aatcaatgat atgatttatt ctcttctgga aaaaggtagg cttatcatta
21421 gagaaaacaa cagagttgtg gtttcaagtg atattcttgt taacaactaa acgaacatgt
21481 ttattttctt attatttctt actctcacta gtggtagtga ccttgaccgg tgcaccactt
21541 ttgatgatgt tcaagctcct aattacactc aacatacttc atctatgagg ggggtttact
21601 atcctgatga aatttttaga tcagacactc tttatttaac tcaggattta tttcttccat
21661 tttattctaa tgttacaggg tttcatacta ttaatcatac gtttgacaac cctgtcatac
21721 cttttaagga tggtatttat tttgctgcca cagagaaatc aaatgttgtc cgtggttggg
21781 tttttggttc taccatgaac aacaagtcac agtcggtgat tattattaac aattctacta
21841 atgttgttat acgagcatgt aactttgaat tgtgtgacaa cccttttctt gctgtttcta
21901 aacccatggg tacacagaca catactatga tattcgataa tgcatttaat gcactttcg
21961 agtacatatc tgatgccttt cgcttgatg tttcagaaaa gtcaggtaat tttaaacact
22021 tacgagagtt tgtgtttaaa aataaagatg ggtttctcta tgtttataag ggctatcaac
22081 ctatagatgt agttcgtgat ctaccttctg gttttaacac tttgaaacct attttttaagt
22141 tgcctcttgg tattaacatt acaaatttta gagccattct tacagccttt tcacctgctc
22201 aagacacttg gggcacgtca gctgcagcct attttgttgg ctatttaaag ccaactacat
22261 ttatgctcaa gtatgatgaa aatggtacaa tcacagatgc tgttgattgt tctcaaaatc
22321 cacttgctga actcaaatgc tctgttaaga gctttgagat tgacaaagga atttaccaga
22381 cctctaattt cagggttgtt ccctcaggag atgttgtgag attccctaat attacaaact
22441 tgtgtccttt tggagaggtt tttaatgcta ctaaattccc ttctgtctat gcatgggaga
22501 gaaaaaaat ttctaattgt gttgctgatt actctgtgct ctacaactca acatttttt
22561 caacctttaa gtgctatggc gtttctgcca ctaagttgaa tgatctttgc ttctccaatg
22621 tctatgcaga ttcttttgta gtcaagggag atgatgtaag acaaatagcg ccaggacaaa
22681 ctggtgttat tgctgattat aattataaat tgccagatga tttcatgggt tgtgtccttg
22741 cttggaatac taggaacatt gatgctactt caactggtaa ttataattat aaatataggt
22801 atcttagaca tggcaagctt aggccctttg agagagacat atctaatgtg cctttctccc
22861 ctgatggcaa accttgcacc ccacctgctc ttaattgtta ttggccatta aatgattatg
22921 gttttacac cactactggc attggctacc aaccttacag agttgtagta cttcttttg
22981 aacttttaaa tgcaccggcc acggtttgtg gaccaaaatt atccactgac cttattaaga
23041 accagtgtgt caatttaat tttaatggac tcactggtac tggtgtgtta actccttctt
```

FIG. 3 CONT'D

```
23101 caaagagatt tcaaccattt caacaatttg gccgtgatgt ttctgatttc actgattccg
23161 ttcgagatcc taaaacatct gaaatattag acatttcacc ttgctctttt gggggtgtaa
23221 gtgtaattac acctggaaca aatgcttcat ctgaagttgc tgttctatat caagatgtta
23281 actgcactga tgtttctaca gcaattcatg cagatcaact cacaccagct tggcgcatat
23341 attctactgg aaacaatgta ttccagactc aagcaggctg tcttatagga gctgagcatg
23401 tcgacacttc ttatgagtgc gacattccta ttggagctgg catttgtgct agttaccata
23461 cagtttcttt attacgtagt actagccaaa aatctattgt ggcttatact atgtctttag
23521 gtgctgatag ttcaattgct tactctaata acaccattgc tatacctact aacttttcaa
23581 ttagcattac tacagaagta atgcctgttt ctatggctaa aacctccgta gattgtaata
23641 tgtacatctg cggagattct actgaatgtg ctaatttgct tctccaatat ggtagctttt
23701 gcacacaact aaatcgtgca ctctcaggta ttgctgctga acaggatcgc aacacacgtg
23761 aagtgttcgc tcaagtcaaa caaatgtaca aacccaac tttgaaatat tttggtggtt
23821 ttaatttttc acaaatatta cctgaccctc taaagccaac taagaggtct tttattgagg
23881 acttgctctt taataaggtg acactcgctg atgctggctt catgaagcaa tatggcgaat
23941 gcctaggtga tattaatgct agagatctca tttgtgcgca gaagttcaat ggacttacag
24001 tgttgccacc tctgctcact gatgatatga ttgctgccta cactgctgct ctagttagtg
24061 gtactgccac tgctggatgg acatttggtg ctggcgctgc tcttcaaata ccttttgcta
24121 tgcaaatggc ataggttc aatggcattg gagttaccca aaatgttctc tatgagaacc
24181 aaaaacaaat cgccaaccaa tttaacaagg cgattagtca aattcaagaa tcacttacaa
24241 caacatcaac tgcattgggc aagctgcaag acgttgttaa ccagaatgct caagcattaa
24301 acacacttgt taaacaactt agctctaatt ttggtgcaat ttcaagtgtg ctaaatgata
24361 tccttttcgcg acttgataaa gtcgaggcgg aggtacaaat tgacaggtta attacaggca
24421 gacttcaaag ccttcaaacc tatgtaacac aacaactaat cagggctgct gaaatcaggg
24481 cttctgctaa tcttgctgct actaaaatgt ctgagtgtgt tcttggacaa tcaaaaagag
24541 ttgacttttg tggaaagggc taccaccta tgtccttccc acaagcagcc ccgcatggtg
24601 ttgtcttcct acatgtcacg tatgtgccat cccaggagag gaacttcacc acagcgccag
24661 caatttgtca tgaaggcaaa gcatacttcc ctcgtgaagg tgttttttgtg tttaatggca
24721 cttcttggtt tattacacag aggaacttct tttctccaca ataattact acagacaata
24781 catttgtctc aggaaattgt gatgtcgtta ttggcatcat taacaacaca gtttatgatc
24841 ctctgcaacc tgagcttgac tcattcaaag aagagctgga caagtacttc aaaaatcata
24901 catcaccaga tgttgatctt ggcgacattt caggcattaa cgcttctgtc gtcaacattc
24961 aaaaagaaat tgaccgcctc aatgaggtcg ctaaaaattt aaatgaatca ctcattgacc
25021 ttcaagaatt gggaaaatat gagcaatata ttaaatggcc ttggtatgtt tggctcggct
25081 tcattgctgg actaattgcc atcgtcatgg ttacaatctt gctttgttgc atgactagtt
25141 gttgcagttg cctcaagggt gcatgctctt gtggttcttg ctgcaagttt gatgaggatg
25201 actctgagcc agttctcaag ggtgtcaaat tacattacac ataaacgaac ttatggattt
25261 gtttatgaga ttttttactc ttggatcaat tactgcacag ccagtaaaaa ttgacaatgc
25321 ttctcctgca agtactgttc atgctacagc aacgataccg ctacaagcct cactcccttt
25381 cggatggctt gttattggcg ttgcatttct tgctgttttt cagagcgcta ccaaaataat
25441 tgcgctgcaat aaaagatggc agctagccct ttataagggc ttccagttca tttgcaattt
25501 actgctgcta tttgttacca tctattcaca tcttttgctt gtcgctgcag gtatggaggc
25561 gcaatttttg tacctctatg ccttgatata ttttctacaa tgcatcaacg catgtagaat
25621 tattatgaca tgttggcttt gttggaagtg caaatccaag acccattac tttatgatgc
25681 caactacttt gtttgctggc acacacataa ctatgactac tgtataccat ataacagtgt
25741 cacagataca attgtcgtta ctgaaggtga cggcatttca acaccaaaac tcaaagaaga
25801 ctaccaaatt ggtggttatt ctgaggatag cactcaggt gttaaagact atgtcgttgt
25861 acatggctat ttcaccgaag tttactacca gcttgagtct acacaaatta ctacagacac
25921 tggtattgaa aatgctacat tcttcatctt taacaagctt gttaaagacc caccgaatgt
25981 gcaaatacac acaatcgacg gctcttcagg agttgctaat ccagcaatgg atccaattta
26041 tgatgagccg acgacgacta ctagcgtgcc tttgtaagca caagaaagtg agtacgaact
26101 tatgtactca ttcgtttcgg aagaaacagg tacgttaata gttaatagcg tacttctttt
26161 tcttgctttc gtggtattct tgctagtcac actagccatc cttactgcgc ttcgattgtg
26221 tgcgtactgc tgcaatattg ttaacgtgag tttagtaaaa ccaacggttt acgtctactc
26281 gcgtgttaaa aatctgaact cttctgaagg agttcctgat cttctggtct aaacgaacta
26341 actattatta ttattctgtt tggaacttta acattgctta tcatggcaga caacggtact
```

FIG. 3 CONT'D

```
26401 attaccgttg aggagcttaa acaactcctg gaacaatgga acctagtaat aggtttccta
26461 ttcctagcct ggattatgtt actacaattt gcctattcta atcggaacag gttttgtac
26521 ataataaagc ttgttttcct ctggctcttg tggccagtaa cacttgcttg ttttgtgctt
26581 gctgctgtct acagaattaa ttgggtgact ggcgggattg cgattgcaat ggcttgtatt
26641 gtaggcttga tgtggcttag ctacttcgtt gcttccttca ggctgtttgc tcgtacccgc
26701 tcaatgtggt cattcaaccc agaaacaaac attcttctca atgtgcctct ccgggggaca
26761 attgtgacca gaccgctcat ggaaagtgaa cttgtcattg gtgctgtgat cattcgtggt
26821 cacttgcgaa tggccggaca ctccctaggg cgctgtgaca ttaaggacct gccaaaagag
26881 atcactgtgg ctacatcacg aacgctttct tattacaaat taggagcgtc gcagcgtgta
26941 ggcactgatt caggttttgc tgcatacaac cgctaccgta ttggaaacta taaattaaat
27001 acagaccacg ccggtagcaa cgacaatatt gctttgctag tacagtaagt gacaacagat
27061 gtttcatctt gttgacttcc aggttacaat agcagagata ttgattatca ttatgaggac
27121 tttcaggatt gctatttgga atcttgacgt tataataagt tcaatagtga acaattatt
27181 taagcctcta actaagaaga attattcgga gttagatgat gaagaaccta tggagttaga
27241 ttatccataa aacgaacatg aaaattattc tcttcctgac attgattgta tttacatctt
27301 gcgagctata tcactatcag gagtgtgtta gaggtacgac tgtactacta aaagaacctt
27361 gcccatcagg aacatacgag ggcaattcac catttcaccc tcttgctgac aataaatttg
27421 cactaacttg cactagcaca cactttgctt ttgcttgtgc tgacggtact cgacataccct
27481 atcagctgcg tgcaagatca gtttcaccaa aactttcat cagacaagag gaggttcaac
27541 aagagctcta ctcgccactt tttctcattg ttgctgctct agtattttta atactttgct
27601 tcaccattaa gagaaagaca gaatgaatga gctcacttta attgacttct atttgtgctt
27661 tttagccttt ctgctattcc ttgttttaat aatgcttatt atattttggt tttcactcga
27721 aatccaggat ctagaagaac cttgtaccaa agtctaaacg aacatgaaac ttctcattgt
27781 tttgacttgt atttctctat gcagttgcat acgcactgta gtacagcgct gtgcatctaa
27841 taaacctcat gtgcttgaag atccttgtaa ggtacaacac taggggtaat acttatagca
27901 ctgcttggct ttgtgctcta ggaaaggttt tacctttttca tagatggcac actatggttc
27961 aaacatgcac acctaatgtt actatcaact gtcaagatcc agctggtggt gcgcttatag
28021 ctaggtgttg gtaccttcat gaaggtcacc aaactgctgc atttagagac gtacttgttg
28081 ttttaaataa acgaacaaat taaaatgtct gataatggac cccaatcaaa ccaacgtagt
28141 gccccccgca ttacatttgg tggacccaca gattcaactg acaataacca gaatggagga
28201 cgcaatgggg caaggccaaa acagcgccga ccccaaggtt tacccaataa tactgcgtct
28261 tggttcacag ctctcactca gcatggcaag gaggaactta gattccctcg aggccagggc
28321 gttccaatca acaccaatag tggtccagat gaccaaattg gctactaccg aagagctacc
28381 cgacgagttc gtggtggtga cggcaaaatg aaagagctca gccccagatg gtacttctat
28441 tacctaggaa ctggcccaga agcttcactt ccctacggcg ctaacaaaga aggcatcgta
28501 tgggttgcaa ctgagggagc cttgaataca cccaaagacc acattggcac ccgcaatcct
28561 aataacaatg ctgccaccgt gctacaactt cctcaaggaa caacattgcc aaaaggcttc
28621 tacgcagagg gaagcagagg cggcagtcaa gcctcttctc gctcctcatc acgtagtcgc
28681 ggtaattcaa gaaattcaac tcctggcagc agtaggggaa ttctcctgc tcgaatggct
28741 agcggaggtg gtgaaactgc cctcgcgcta ttgctgctag acagattgaa ccagcttgag
28801 agcaaagttt ctggtaaagg ccaacaacaa caaggccaaa ctgtcactaa gaaatctgct
28861 gctgaggcat ctaaaaagcc tcgccaaaaa cgtactgcca caaaacagta caacgtcact
28921 caagcatttg ggagacgtgg tccagaacaa acccaaggaa atttcggga ccaagaccta
28981 atcagacaag gaactgatta caaacattgg ccgcaaattg cacaatttgc tccaagtgcc
29041 tctgcattct ttggaatgtc acgcattggc atggaagtca caccttcggg aacatggctg
29101 acttatcatg gagccattaa attggatgac aaagatccac aattcaaaga caacgtcata
29161 ctgctgaaca agcacattga cgcatacaaa acattcccac caacagagcc taaaaaggac
29221 aaaaagaaaa agactgatga agctcagcct ttgccgcaga gacaaaagaa gcagccccact
29281 gtgactcttc ttcctgcggc tgacatggat gatttctcca gacaacttca aaattccatg
29341 agtggagctt ctgctgattc aactcaggca taaacactca tgatgaccac acaaggcaga
29401 tgggctatgt aaacgttttc gcaattccgt ttacgataca tagtctactc ttgtgcagaa
29461 tgaattctcg taactaaaca gcacaagtag gtttagttaa ctttaatctc acatagcaat
29521 ctttaatcaa tgtgtaacat tagggaggac ttgaaagagc caccacattt tcatcgaggc
29581 cacgcggagt acgatcgagg gtacagtgaa taatgctagg gagagctgcc tatatggaag
29641 agccctaatg tgtaaaatta attttagtag tgctatcccc atgtgatttt aatagcttct
29701 taggagaatg acaaaaaaaa aaaaaaaaa aaaaaa
```

FIG. 3 CONT'D

```
  1 - CTACCCAGGAAAAGCCAACCAACCTCGATCTCTTGTAGATCTGTTCTCTAAACGAACTTT -  60
    - L  P  R  K  S  Q  P  T  S  I  S  C  R  S  V  L  *  T  N  F
    -  Y  P  G  K  A  N  Q  P  R  S  L  V  D  L  F  S  K  R  T  L
    -   T  Q  E  K  P  T  N  L  D  L  L  *  I  C  S  L  N  E  L  *
 61 - AAAATCTGTGTAGCTGTCGCTCGGCTGCATGCCTAGTGCACCTACGCAGTATAAACAATA - 120
    - K  I  C  V  A  V  A  R  L  H  A  *  C  T  Y  A  V  *  T  I
    -  K  S  V  *  L  S  L  G  C  M  P  S  A  P  T  Q  Y  K  Q  *
    -   N  L  C  S  C  R  S  A  A  C  L  V  H  L  R  S  I  N  N  N
121 - ATAAATTTACTGTCGTTGACAAGAAACGAGTAACTCGTCCCTCTTCTGCAGACTGCTTA - 180
    - I  N  F  T  V  V  D  K  K  R  V  T  R  P  S  S  A  D  C  L
    -  *  I  L  L  S  L  T  R  N  E  *  L  V  P  L  L  Q  T  A  Y
    -   K  F  Y  C  R  *  Q  E  T  S  N  S  S  L  F  C  R  L  L  T
181 - CGGTTTCGTCCGTGTTGCAGTCGATCATCAGCATACCTAGGTTTCGTCCGGGTGTGACCG - 240
    - R  F  R  P  C  C  S  R  S  S  A  Y  L  G  F  V  R  V  *  P
    -  G  F  V  R  V  A  V  D  H  Q  H  T  *  V  S  S  G  C  D  R
    -   V  S  S  V  L  Q  S  I  I  S  I  P  R  F  R  P  G  V  T  E
241 - AAAGGTAAGATGGAGAGCCTTGTTCTTGGTGTCAACGAGAAAACACACGTCCAACTCAGT - 300
    - K  G  K  M  E  S  L  V  L  G  V  N  E  K  T  H  V  Q  L  S
    -  K  V  R  W  R  A  L  F  L  V  S  T  R  K  H  T  S  N  S  V
    -   R  *  D  G  E  P  C  S  W  C  Q  R  E  N  T  R  P  T  Q  F
301 - TTGCCTGTCCTTCAGGTTAGAGACGTGCTAGTGCGTGGCTTCGGGGACTCTGTGGAAGAG - 360
    - L  P  V  L  Q  V  R  D  V  L  V  R  G  F  G  D  S  V  E  E
    -  C  L  S  F  R  L  E  T  C  *  C  V  A  S  G  T  L  W  K  R
    -   A  C  P  S  G  *  R  R  A  S  A  W  L  R  G  L  C  G  R  G
361 - GCCCTATCGGAGGCACGTGAACACCTCAAAAATGGCACTTGTGGTCTAGTAGAGCTGGAA - 420
    - A  L  S  E  A  R  E  H  L  K  N  G  T  C  G  L  V  E  L  E
    -  P  Y  R  R  H  V  N  T  S  K  M  A  L  V  V  *  *  S  W  K
    -   P  I  G  G  T  *  T  P  Q  K  W  H  L  W  S  S  R  A  G  K
421 - AAAGGCGTACTGCCCCAGCTTGAACAGCCCTATGTGTTCATTAAACGTTCTGATGCCTTA - 480
    - K  G  V  L  P  Q  L  E  Q  P  Y  V  F  I  K  R  S  D  A  L
    -  K  A  Y  C  P  S  L  N  S  P  M  C  S  L  N  V  L  M  P  *
    -   R  R  T  A  P  A  *  T  A  L  C  V  H  *  T  F  *  C  L  K
481 - AGCACCAATCACGGCCACAAGGTCGTTGAGCTGGTTGCAGAAATGGACGGCATTCAGTAC - 540
    - S  T  N  H  G  H  K  V  V  E  L  V  A  E  M  D  G  I  Q  Y
    -  A  P  I  T  A  T  R  S  L  S  W  L  Q  K  W  T  A  F  S  T
    -   H  Q  S  R  P  Q  G  R  *  A  G  C  R  N  G  R  H  S  V  R
541 - GGTCGTAGCGGTATAACACTGGGAGTACTCGTGCCACATGTGGGCGAAACCCCAATTGCA - 600
    - G  R  S  G  I  T  L  G  V  L  V  P  H  V  G  E  T  P  I  A
    -  V  V  A  V  *  H  W  E  Y  S  C  H  M  W  A  K  P  Q  L  H
    -   S  *  R  Y  N  T  G  S  T  R  A  T  C  G  R  N  P  N  C  I
601 - TACCGCAATGTTCTTCTTCGTAAGAACGGTAATAAGGGAGCCGGTGGTCATAGCTATGGC - 660
    - Y  R  N  V  L  L  R  K  N  G  N  K  G  A  G  G  H  S  Y  G
    -  T  A  M  F  F  F  V  R  T  V  I  R  E  P  V  V  I  A  M  A
    -   P  Q  C  S  S  S  *  E  R  *  *  G  S  R  W  S  *  L  W  H
661 - ATCGATCTAAAGTCTTATGACTTAGGTGACGAGCTTGGCACTGATCCCATTGAAGATTAT - 720
    - I  D  L  K  S  Y  D  L  G  D  E  L  G  T  D  P  I  E  D  Y
    -  S  I  *  S  L  M  T  *  V  T  S  L  A  L  I  P  L  K  I  M
    -   R  S  K  V  L  *  L  R  *  R  A  W  H  *  S  H  *  R  L  *
721 - GAACAAAACTGGAACACTAAGCATGGCAGTGGTGCACTCCGTGAACTCACTCGTGAGCTC - 780
    - E  Q  N  W  N  T  K  H  G  S  G  A  L  R  E  L  T  R  E  L
    -  N  K  T  G  T  L  S  M  A  V  V  H  S  V  N  S  L  V  S  S
    -   T  K  L  E  H  *  A  W  Q  W  C  T  P  *  T  H  S  *  A  Q
781 - AATGGAGGTGCAGTCACTCGCTATGTCGACAACAATTTCTGTGGCCCAGATGGGTACCCT - 840
    - N  G  G  A  V  T  R  Y  V  D  N  N  F  C  G  P  D  G  Y  P
    -  M  E  V  Q  S  L  A  M  S  T  T  I  S  V  A  Q  M  G  T  L
    -   W  R  C  S  H  S  L  C  R  Q  Q  F  L  W  P  R  W  V  P  S
841 - CTTGATTGCATCAAAGATTTCTCGCACGCGCGGGCAAGTCAATGTGCACTCTTTCCGAA - 900
    - L  D  C  I  K  D  F  L  A  R  A  G  K  S  M  C  T  L  S  E
    -  L  I  A  S  K  I  F  S  H  A  R  A  S  Q  C  A  L  F  P  N
    -   *  L  H  Q  R  F  S  R  T  R  G  Q  V  N  V  H  S  F  R  T
```

FIG. 4

```
 901 - CAACTTGATTACATCGAGTCGAAGAGAGGTGTCTACTGCTGCCGTGACCATGAGCATGAA -  960
     -  Q  L  D  Y  I  E  S  K  R  G  V  Y  C  C  R  D  H  E  H  E
     -  N  L  I  T  S  S  R  R  E  V  S  T  A  A  V  T  M  S  M  K
     -  T  *  L  H  R  V  E  E  R  C  L  L  P  *  P  *  A  *  N
 961 - ATTGCCTGGTTCACTGAGCGCTCTGATAAGAGCTACGAGCACCAGACACCCTTCGAAATT - 1020
     -  I  A  W  F  T  E  R  S  D  K  S  Y  E  H  Q  T  P  F  E  I
     -  L  P  G  S  L  S  A  L  I  R  A  T  S  T  R  H  P  S  K  L
     -  C  L  V  H  *  A  L  *  *  E  L  R  A  P  D  T  L  R  N  *
1021 - AAGAGTGCCAAGAAATTTGACACTTTCAAAGGGGAATGCCCAAAGTTTGTGTTTCCTCTT - 1080
     -  K  S  A  K  K  F  D  T  F  K  G  E  C  P  K  F  V  F  P  L
     -  R  V  P  R  N  L  T  L  S  K  G  N  A  Q  S  L  C  F  L  L
     -  E  C  Q  E  I  *  H  F  Q  R  G  M  P  K  V  C  V  S  S  *
1081 - AACTCAAAAGTCAAAGTCATTCAACCACGTGTTGAAAAGAAAAAGACTGAGGGTTTCATG - 1140
     -  N  S  K  V  K  V  I  Q  P  R  V  E  K  K  K  T  E  G  F  M
     -  T  Q  K  S  K  S  F  N  H  V  L  K  R  K  R  L  R  V  S  W
     -  L  K  S  Q  S  H  S  T  T  C  *  K  E  K  D  *  G  F  H  G
1141 - GGGCGTATACGCTCTGTGTACCCTGTTGCATCTCCACAGGAGTGTAACAATATGCACTTG - 1200
     -  G  R  I  R  S  V  Y  P  V  A  S  P  Q  E  C  N  N  M  H  L
     -  G  V  Y  A  L  C  T  L  L  H  L  H  R  S  V  T  I  C  T  C
     -  A  Y  T  L  C  V  P  C  C  I  S  T  G  V  *  Q  Y  A  L  V
1201 - TCTACCTTGATGAAATGTAATCATTGCGATGAAGTTTCATGGCAGACGTGCGACTTTCTG - 1260
     -  S  T  L  M  K  C  N  H  C  D  E  V  S  W  Q  T  C  D  F  L
     -  L  P  *  *  N  V  I  I  A  M  K  F  H  G  R  R  A  T  F  *
     -  Y  L  D  E  M  *  S  L  R  *  S  F  M  A  D  V  R  L  S  E
1261 - AAAGCCACTTGTGAACATTGTGGCACTGAAAATTTAGTTATTGAAGGACCTACTACATGT - 1320
     -  K  A  T  C  E  H  C  G  T  E  N  L  V  I  E  G  P  T  T  C
     -  K  P  L  V  N  I  V  A  L  K  I  *  L  L  K  D  L  L  H  V
     -  S  H  L  *  T  L  W  H  *  K  F  S  Y  *  R  T  Y  Y  M  W
1321 - GGGTACCTACCTACTAATGCTGTAGTGAAAATGCCATGTCCTGCCTGTCAAGACCCAGAG - 1380
     -  G  Y  L  P  T  N  A  V  V  K  M  P  C  P  A  C  Q  D  P  E
     -  G  T  Y  L  L  M  L  *  *  K  C  H  V  L  P  V  K  T  Q  R
     -  V  P  T  Y  *  C  C  S  E  N  A  M  S  C  L  S  R  P  R  D
1381 - ATTGGACCTGAGCATAGTGTTGCAGATTATCACAACCACTCAAACATTGAAACTCGACTC - 1440
     -  I  G  P  E  H  S  V  A  D  Y  H  N  H  S  N  I  E  T  R  L
     -  L  D  L  S  I  V  L  Q  I  I  T  T  T  Q  T  L  K  L  D  S
     -  W  T  *  A  *  C  C  R  L  S  Q  P  L  K  H  *  N  S  T  P
1441 - CGCAAGGGAGGTAGGACTAGATGTTTTGGAGGCTGTGTGTTTGCCTATGTTGGCTGCTAT - 1500
     -  R  K  G  G  R  T  R  C  F  G  G  C  V  F  A  Y  V  G  C  Y
     -  A  R  E  V  G  L  D  V  L  E  A  V  C  L  P  M  L  A  A  I
     -  Q  G  R  *  D  *  M  F  W  R  L  C  V  C  L  C  W  L  L  *
1501 - AATAAGCGTGCCTACTGGGTTCCTCGTGCTAGTGCTGATATTGGCTCAGGCCATACTGGC - 1560
     -  N  K  R  A  Y  W  V  P  R  A  S  A  D  I  G  S  G  H  T  G
     -  I  S  V  P  T  G  F  L  V  L  V  L  I  L  A  Q  A  I  L  A
     -  *  A  C  L  L  G  S  S  C  *  C  *  Y  W  L  R  P  Y  W  H
1561 - ATTACTGGTGACAATGTGGAGACCTTGAATGAGGATCTCCTTGAGATACTGAGTCGTGAA - 1620
     -  I  T  G  D  N  V  E  T  L  N  E  D  L  L  E  I  L  S  R  E
     -  L  L  V  T  M  W  R  P  *  M  R  I  S  L  R  Y  *  V  V  N
     -  Y  W  *  Q  C  G  D  L  E  *  G  S  P  *  D  T  E  S  *  T
1621 - CGTGTTAACATTAACATTGTTGGCGATTTTCATTTGAATGAAGAGGTTGCCATCATTTTG - 1680
     -  R  V  N  I  N  I  V  G  D  F  H  L  N  E  E  V  A  I  I  L
     -  V  L  T  L  T  L  L  A  I  F  I  *  M  K  R  L  P  S  F  W
     -  C  *  H  *  H  C  W  R  F  S  F  E  *  R  G  C  H  H  F  G
1681 - GCATCTTTCTCTGCTTCTACAAGTGCCTTTATTGACACTATAAAGAGTCTTGATTACAAG - 1740
     -  A  S  F  S  A  S  T  S  A  F  I  D  T  I  K  S  L  D  Y  K
     -  H  L  S  L  L  L  Q  V  P  L  L  T  L  *  R  V  L  I  T  S
     -  I  F  L  C  F  Y  K  C  L  Y  *  H  Y  K  E  S  *  L  Q  V
1741 - TCTTTCAAAACCATTGTTGAGTCCTGCGGTAACTATAAAGTTACCAAGGGAAAGCCCGTA - 1800
     -  S  F  K  T  I  V  E  S  C  G  N  Y  K  V  T  K  G  K  P  V
     -  L  S  K  P  L  L  S  P  A  V  T  I  K  L  P  R  E  S  P  *
     -  F  Q  N  H  C  *  V  L  R  *  L  *  S  Y  Q  G  K  A  R  K
```

FIG. 4 Cont'd

```
1801 - AAAGGTGCTTGGAACATTGGACAACAGAGATCAGTTTTAACACCACTGTGTGGTTTTCCC - 1860
     -  K  G  A  W  N  I  G  Q  Q  R  S  V  L  T  P  L  C  G  F  P
     -  K  V  L  G  T  L  D  N  R  D  Q  F  *  H  H  C  V  V  F  P
     -  R  C  L  E  H  W  T  T  E  I  S  F  N  T  T  V  W  F  S  L
1861 - TCACAGGCTGCTGGTGTTATCAGATCAATTTTTGCGCGCACACTTGATGCAGCAAACCAC - 1920
     -  S  Q  A  A  G  V  I  R  S  I  F  A  R  T  L  D  A  A  N  H
     -  H  R  L  L  V  L  S  D  Q  F  L  R  A  H  L  M  Q  Q  T  T
     -  T  G  C  W  C  Y  Q  I  N  F  C  A  H  T  *  C  S  K  P  L
1921 - TCAATTCCTGATTTGCAAAGAGCAGCTGTCACCATACTTGATGGTATTTCTGAACAGTCA - 1980
     -  S  I  P  D  L  Q  R  A  A  V  T  I  L  D  G  I  S  E  Q  S
     -  Q  F  L  I  C  K  E  Q  L  S  P  Y  L  M  V  F  L  N  S  H
     -  N  S  *  F  A  K  S  S  C  H  H  T  *  W  Y  F  *  T  V  I
1981 - TTACGTCTTGTCGACGCCATGGTTTATACTTCAGACCTGCTCACCAACAGTGTCATTATT - 2040
     -  L  R  L  V  D  A  M  V  Y  T  S  D  L  L  T  N  S  V  I  I
     -  Y  V  L  S  T  P  W  F  I  L  Q  T  C  S  P  T  V  S  L  L
     -  T  S  C  R  R  H  G  L  Y  F  R  P  A  H  Q  Q  C  H  Y  Y
2041 - ATGGCATATGTAACTGGTGGTCTTGTACAACAGACTTCTCAGTGGTTGTCTAATCTTTTG - 2100
     -  M  A  Y  V  T  G  G  L  V  Q  Q  T  S  Q  W  L  S  N  L  L
     -  W  H  M  *  L  V  V  L  Y  N  R  L  L  S  G  C  L  I  F  W
     -  G  I  C  N  W  W  S  C  T  T  D  F  S  V  V  V  *  S  F  G
2101 - GGCACTACTGTTGAAAAACTCAGGCCTATCTTTGAATGGATTGAGGCGAAACTTAGTGCA - 2160
     -  G  T  T  V  E  K  L  R  P  I  F  E  W  I  E  A  K  L  S  A
     -  A  L  L  L  K  N  S  G  L  S  L  N  G  L  R  R  N  L  V  Q
     -  H  Y  C  *  K  T  Q  A  Y  L  *  M  D  *  G  E  T  *  C  R
2161 - GGAGTTGAATTTCTCAAGGATGCTTGGGAGATTCTCAAATTTCTCATTACAGGTGTTTTT - 2220
     -  G  V  E  F  L  K  D  A  W  E  I  L  K  F  L  I  T  G  V  F
     -  E  L  N  F  S  R  M  L  G  R  F  S  N  F  S  L  Q  V  F  L
     -  S  *  I  S  Q  G  C  L  G  D  S  Q  I  S  H  Y  R  C  F  *
2221 - GACATCGTCAAGGGTCAAATACAGGTTGCTTCAGATAACATCAAGGATTGTGTAAAATGC - 2280
     -  D  I  V  K  G  Q  I  Q  V  A  S  D  N  I  K  D  C  V  K  C
     -  T  S  S  R  V  K  Y  R  L  L  Q  I  T  S  R  I  V  *  N  A
     -  H  R  Q  G  S  N  T  G  C  F  R  *  H  Q  G  L  C  K  M  L
2281 - TTCATTGATGTTGTTAACAAGGCACTCGAAATGTGCATTGATCAAGTCACTATCGCTGGC - 2340
     -  F  I  D  V  V  N  K  A  L  E  M  C  I  D  Q  V  T  I  A  G
     -  S  L  M  L  L  T  R  H  S  K  C  A  L  I  K  S  L  S  L  A
     -  H  *  C  C  *  Q  G  T  R  N  V  H  *  S  S  H  Y  R  W  R
2341 - GCAAAGTTGCGATCACTCAACTTAGGTGAAGTCTTCATCGCTCAAAGCAAGGGACTTTAC - 2400
     -  A  K  L  R  S  L  N  L  G  E  V  F  I  A  Q  S  K  G  L  Y
     -  Q  S  C  D  H  S  T  *  V  K  S  S  S  L  K  A  R  D  F  T
     -  K  V  A  I  T  Q  L  R  *  S  L  H  R  S  K  Q  G  T  L  P
2401 - CGTCAGTGTATACGTGGCAAGGAGCAGCTGCAACTACTCATGCCTCTTAAGGCACCAAAA - 2460
     -  R  Q  C  I  R  G  K  E  Q  L  Q  L  L  M  P  L  K  A  P  K
     -  V  S  V  Y  V  A  R  S  S  C  N  Y  S  C  L  L  R  H  Q  K
     -  S  V  Y  T  W  Q  G  A  A  A  T  T  H  A  S  *  G  T  K  R
2461 - GAAGTAACCTTTCTTGAAGGTGATTCACATGACACAGTACTTACCTCTGAGGAGGTTGTT - 2520
     -  E  V  T  F  L  E  G  D  S  H  D  T  V  L  T  S  E  E  V  V
     -  K  *  P  F  L  K  V  I  H  M  T  Q  Y  L  P  L  R  R  L  F
     -  S  N  L  S  *  R  *  F  T  *  H  S  T  Y  L  *  G  G  C  S
2521 - CTCAAGAACGGTGAACTCGAAGCACTCGAGACGCCCGTTGATAGCTTCACAAATGGAGCT - 2580
     -  L  K  N  G  E  L  E  A  L  E  T  P  V  D  S  F  T  N  G  A
     -  S  R  T  V  N  S  K  H  S  R  R  P  L  I  A  S  Q  M  E  L
     -  Q  E  R  *  T  R  S  T  R  D  A  R  *  *  L  H  K  W  S  Y
2581 - ATCGTTGGCACACCAGTCTGTGTAAATGGCCTCATGCTCTTAGAGATTAAGGACAAAGAA - 2640
     -  I  V  G  T  P  V  C  V  N  G  L  M  L  L  E  I  K  D  K  E
     -  S  L  A  H  Q  S  V  *  M  A  S  C  S  *  R  L  R  T  K  N
     -  R  W  H  T  S  L  C  K  W  P  H  A  L  R  D  *  G  Q  R  T
2641 - CAATACTGCGCATTGTCTCCTGGTTTACTGGCTACAAACAATGTCTTTCGCTTAAAAGGG - 2700
     -  Q  Y  C  A  L  S  P  G  L  L  A  T  N  N  V  F  R  L  K  G
     -  N  T  A  H  C  L  L  V  Y  W  L  Q  T  M  S  F  A  *  K  G
     -  I  L  R  I  V  S  W  F  T  G  Y  K  Q  C  L  S  L  K  R  G
```

FIG. 4 Cont'd

```
2701 - GGTGCACCAATTAAAGGTGTAACCTTTGGAGAAGATACTGTTTGGGAAGTTCAAGGTTAC - 2760
     - G  A  P  I  K  G  V  T  F  G  E  D  T  V  W  E  V  Q  G  Y
     -  V  H  Q  L  K  V  *  P  L  E  K  I  L  F  G  K  F  K  V  T
     -   C  T  N  *  R  C  N  L  W  R  R  Y  C  L  G  S  S  R  L  Q
2761 - AAGAATGTGAGAATCACATTTGAGCTTGATGAACGTGTTGACAAAGTGCTTAATGAAAG - 2820
     - K  N  V  R  I  T  F  E  L  D  E  R  V  D  K  V  L  N  E  K
     -  R  M  *  E  S  H  L  S  L  M  N  V  L  T  K  C  L  M  K  S
     -   E  C  E  N  H  I  *  A  *  *  T  C  *  Q  S  A  *  *  K  V
2821 - TGCTCTGTCTACACTGTTGAATCCGGTACCGAAGTTACTGAGTTTGCATGTGTTGTAGCA - 2880
     - C  S  V  Y  T  V  E  S  G  T  E  V  T  E  F  A  C  V  V  A
     -  A  L  S  T  L  L  N  P  V  P  K  L  L  S  L  H  V  L  *  Q
     -   L  C  L  H  C  *  I  R  Y  R  S  Y  *  V  C  M  C  C  S  R
2881 - GAGGCTGTTGTGAAGACTTTACAACCAGTTTCTGATCTCCTTACCAACATGGGTATTGAT - 2940
     - E  A  V  V  K  T  L  Q  P  V  S  D  L  L  T  N  M  G  I  D
     -  R  L  L  *  R  L  Y  N  Q  F  L  I  S  L  P  T  W  V  L  I
     -   G  C  C  E  D  F  T  T  S  F  *  S  P  Y  Q  H  G  Y  *  S
2941 - CTTGATGAGTGGAGTGTAGCTACATTCTACTTATTTGATGATGCTGGTGAAGAAAACTTT - 3000
     - L  D  E  W  S  V  A  T  F  Y  L  F  D  D  A  G  E  E  N  F
     -  L  M  S  G  V  *  L  H  S  T  Y  L  M  M  L  V  K  K  T  F
     -   *  *  V  E  C  S  Y  I  L  L  I  *  *  C  W  *  R  K  L  F
3001 - TCATCACGTATGTATTGTTCCTTTTACCCTCCAGATGAGGAAGAAGAGGACGATGCAGAG - 3060
     - S  S  R  M  Y  C  S  F  Y  P  P  D  E  E  E  E  D  D  A  E
     -  H  H  V  C  I  V  P  F  T  L  Q  M  R  K  K  R  T  M  Q  S
     -   I  T  Y  V  L  F  L  L  P  S  R  *  G  R  R  G  R  C  R  V
3061 - TGTGAGGAAGAAGAAATTGATGAAACCTGTGAACATGAGTACGGTACAGAGGATGATTAT - 3120
     - C  E  E  E  E  I  D  E  T  C  E  H  E  Y  G  T  E  D  D  Y
     -  V  R  K  K  K  L  M  K  P  V  N  M  S  T  V  Q  R  M  I  I
     -   *  G  R  R  N  *  *  N  L  *  T  *  V  R  Y  R  G  *  L  S
3121 - CAAGGTCTCCCTCTGGAATTTGGTGCCTCAGCTGAAACAGTTCGAGTTGAGGAAGAAGAA - 3180
     - Q  G  L  P  L  E  F  G  A  S  A  E  T  V  R  V  E  E  E  E
     -  K  V  S  L  W  N  L  V  P  Q  L  K  Q  F  E  L  R  K  K  K
     -   R  S  P  S  G  I  W  C  L  S  *  N  S  S  S  *  G  R  R  R
3181 - GAGGAAGACTGGCTGGATGATACTACTGAGCAATCAGAGATTGAGCCAGAACCAGAACCT - 3240
     - E  E  D  W  L  D  D  T  T  E  Q  S  E  I  E  P  E  P  E  P
     -  R  K  T  G  W  M  I  L  L  S  N  Q  R  L  S  Q  N  Q  N  L
     -   G  R  L  A  G  *  Y  Y  *  A  I  R  D  *  A  R  T  R  T  Y
3241 - ACACCTGAAGAACCAGTTAATCAGTTTACTGGTTATTTAAAACTTACTGACAATGTTGCC - 3300
     - T  P  E  E  P  V  N  Q  F  T  G  Y  L  K  L  T  D  N  V  A
     -  H  L  K  N  Q  L  I  S  L  L  V  I  *  N  L  L  T  M  L  P
     -   T  *  R  T  S  *  S  V  Y  W  L  F  K  T  Y  *  Q  C  C  H
3301 - ATTAAATGTGTTGACATCGTTAAGGAGGCACAAAGTGCTAATCCTATGGTGATTGTAAAT - 3360
     - I  K  C  V  D  I  V  K  E  A  Q  S  A  N  P  M  V  I  V  N
     -  L  N  V  L  T  S  L  R  R  H  K  V  L  I  L  W  *  L  *  M
     -   *  M  C  *  H  R  *  G  G  T  K  C  *  S  Y  G  D  C  K  C
3361 - GCTGCTAACATACACCTGAAACATGGTGGTGGTGTAGCAGGTGCACTCAACAAGGCAACC - 3420
     - A  A  N  I  H  L  K  H  G  G  G  V  A  G  A  L  N  K  A  T
     -  L  L  T  Y  T  *  N  M  V  V  V  *  Q  V  H  S  T  R  Q  P
     -   C  *  H  T  P  E  T  W  W  W  C  S  R  C  T  Q  Q  G  N  Q
3421 - AATGGTGCCATGCAAAAGGAGAGTGATGATTACATTAAGCTAAATGGCCCTCTTACAGTA - 3480
     - N  G  A  M  Q  K  E  S  D  D  Y  I  K  L  N  G  P  L  T  V
     -  M  V  P  C  K  R  R  V  M  I  T  L  S  *  M  A  L  L  Q  *
     -   W  C  H  A  K  G  E  *  *  L  H  *  A  K  W  P  S  Y  S  R
3481 - GGAGGGTCTTGTTTGCTTTCTGGACATAATCTTGCTAAGAAGTGTCTGCATGTTGTTGGA - 3540
     - G  G  S  C  L  L  S  G  H  N  L  A  K  K  C  L  H  V  V  G
     -  E  G  L  V  C  F  L  D  I  I  L  L  R  S  V  C  M  L  L  D
     -   R  V  L  F  A  F  W  T  *  S  C  *  E  V  S  A  C  C  W  T
3541 - CCTAACCTAAATGCAGGTGAGGACATCCAGCTTCTTAAGGCAGCATATGAAAATTTCAAT - 3600
     - P  N  L  N  A  G  E  D  I  Q  L  L  K  A  A  Y  E  N  F  N
     -  L  T  *  M  Q  V  R  T  S  S  F  L  R  Q  H  M  K  I  S  I
     -   *  P  K  C  R  *  G  H  P  A  S  *  G  S  I  *  K  F  Q  F
```

FIG. 4 Cont'd

```
3601 - TCACAGGACATCTTACTTGCACCATTGTTGTCAGCAGGCATATTTGGTGCTAAACCACTT - 3660
     -  S  Q  D  I  L  L  A  P  L  L  S  A  G  I  F  G  A  K  P  L
     -  H  R  T  S  Y  L  H  H  C  C  Q  Q  A  Y  L  V  L  N  H  F
     -  T  G  H  L  T  C  T  I  V  V  S  R  H  I  W  C  *  T  T  S
3661 - CAGTCTTTACAAGTGTGCGTGCAGACGGTTCGTACACAGGTTTATATTGCAGTCAATGAC - 3720
     -  Q  S  L  Q  V  C  V  Q  T  V  R  T  Q  V  Y  I  A  V  N  D
     -  S  L  Y  K  C  A  C  R  R  F  V  H  R  F  I  L  Q  S  M  T
     -  V  F  T  S  V  R  A  D  G  S  Y  T  G  L  Y  C  S  Q  *  Q
3721 - AAAGCTCTTTATGAGCAGGTTGTCATGGATTATCTTGATAACCTGAAGCCTAGAGTGGAA - 3780
     -  K  A  L  Y  E  Q  V  V  M  D  Y  L  D  N  L  K  P  R  V  E
     -  K  L  F  M  S  R  L  S  W  I  I  L  I  T  *  S  L  E  W  K
     -  S  S  L  *  A  G  C  H  G  L  S  *  *  P  E  A  *  S  G  S
3781 - GCACCTAAACAAGAGGAGCCACCAAACACAGAAGATTCCAAAACTGAGGAGAAATCTGTC - 3840
     -  A  P  K  Q  E  E  P  P  N  T  E  D  S  K  T  E  E  K  S  V
     -  H  L  N  K  R  S  H  Q  T  Q  K  I  P  K  L  R  R  N  L  S
     -  T  *  T  R  G  A  T  K  H  R  R  F  Q  N  *  G  E  I  C  R
3841 - GTACAGAAGCCTGTCGATGTGAAGCCAAAAATTAAGGCCTGCATTGATGAGGTTACCACA - 3900
     -  V  Q  K  P  V  D  V  K  P  K  I  K  A  C  I  D  E  V  T  T
     -  Y  R  S  L  S  M  *  S  Q  K  L  R  P  A  L  M  R  L  P  Q
     -  T  E  A  C  R  C  E  A  K  N  *  G  L  H  *  *  G  Y  H  N
3901 - ACACTGGAAGAAACTAAGTTTCTTACCAATAAGTTACTCTTGTTTGCTGATATCAATGGT - 3960
     -  T  L  E  E  T  K  F  L  T  N  K  L  L  L  F  A  D  I  N  G
     -  H  W  K  K  L  S  F  L  P  I  S  Y  S  C  L  L  I  S  M  V
     -  T  G  R  N  *  V  S  Y  Q  *  V  T  L  V  C  *  Y  Q  W  *
3961 - AAGCTTTACCATGATTCTCAGAACATGCTTAGAGGTGAAGATATGTCTTTCCTTGAGAAG - 4020
     -  K  L  Y  H  D  S  Q  N  M  L  R  G  E  D  M  S  F  L  E  K
     -  S  F  T  M  I  L  R  T  C  L  E  V  K  I  C  L  S  L  R  R
     -  A  L  P  *  F  S  E  H  A  *  R  *  R  Y  V  F  P  *  E  G
4021 - GATGCACCTTACATGGTAGGTGATGTTATCACTAGTGGTGATATCACTTGTGTTGTAATA - 4080
     -  D  A  P  Y  M  V  G  D  V  I  T  S  G  D  I  T  C  V  V  I
     -  M  H  L  T  W  *  V  M  L  S  L  V  V  I  S  L  V  L  *  Y
     -  C  T  L  H  G  R  *  C  Y  H  *  W  *  Y  H  L  C  C  N  T
4081 - CCCTCCAAAAAGGCTGGTGGCACTACTGAGATGCTCTCAAGAGCTTTGAAGAAAGTGCCA - 4140
     -  P  S  K  K  A  G  G  T  T  E  M  L  S  R  A  L  K  K  V  P
     -  P  P  K  R  L  V  A  L  L  R  C  S  Q  E  L  *  R  K  C  Q
     -  L  Q  K  G  W  W  H  Y  *  D  A  L  K  S  F  E  E  S  A  S
4141 - GTTGATGAGTATATAACCACGTACCCTGGACAAGGATGTGCTGGTTATACACTTGAGGAA - 4200
     -  V  D  E  Y  I  T  T  Y  P  G  Q  G  C  A  G  Y  T  L  E  E
     -  L  M  S  I  *  P  R  T  L  D  K  D  V  L  V  I  H  L  R  K
     -  *  *  V  Y  N  H  V  P  W  T  R  M  C  W  L  Y  T  *  G  S
4201 - GCTAAGACTGCTCTTAAGAAATGCAAATCTGCATTTTATGTACTACCTTCAGAAGCACCT - 4260
     -  A  K  T  A  L  K  K  C  K  S  A  F  Y  V  L  P  S  E  A  P
     -  L  R  L  L  L  R  N  A  N  L  H  F  M  Y  Y  L  Q  K  H  L
     -  *  D  C  S  *  E  M  Q  I  C  I  L  C  T  T  F  R  S  T  *
4261 - AATGCTAAGGAAGAGATTCTAGGAACTGTATCCTGGAATTTGAGAGAAATGCTTGCTCAT - 4320
     -  N  A  K  E  E  I  L  G  T  V  S  W  N  L  R  E  M  L  A  H
     -  M  L  R  K  R  F  *  E  L  Y  P  G  I  *  E  K  C  L  L  M
     -  C  *  G  R  D  S  R  N  C  I  L  E  F  E  R  N  A  C  S  C
4321 - GCTGAAGAGACAAGAAAATTAATGCCTATATGCATGGATGTTAGAGCCATAATGGCAACC - 4380
     -  A  E  E  T  R  K  L  M  P  I  C  M  D  V  R  A  I  M  A  T
     -  L  K  R  Q  E  N  *  C  L  Y  A  W  M  L  E  P  *  W  Q  P
     -  *  R  D  K  K  I  N  A  Y  M  H  G  C  *  S  H  N  G  N  H
4381 - ATCCAACGTAAGTATAAAGGAATTAAAATTCAAGAGGGCATCGTTGACTATGGTGTCCGA - 4440
     -  I  Q  R  K  Y  K  G  I  K  I  Q  E  G  I  V  D  Y  G  V  R
     -  S  N  V  S  I  K  E  L  K  F  K  R  A  S  L  T  M  V  S  D
     -  P  T  *  V  *  R  N  *  N  S  R  G  H  R  *  L  W  C  P  I
4441 - TTCTTCTTTTATACTAGTAAAGAGCCTGTAGCTTCTATTATTACGAAGCTGAACTCTCTA - 4500
     -  F  F  F  Y  T  S  K  E  P  V  A  S  I  I  T  K  L  N  S  L
     -  S  S  F  I  L  V  K  S  L  *  L  L  L  R  S  *  T  L  *
     -  L  L  L  Y  *  *  R  A  C  S  F  Y  Y  Y  E  A  E  L  S  K
```

FIG. 4 Cont'd

```
4501 - AATGAGCCGCTTGTCACAATGCCAATTGGTTATGTGACACATGGTTTTAATCTTGAAGAG - 4560
     - N  E  P  L  V  T  M  P  I  G  Y  V  V  T  H  G  F  N  L  E  E
     -  M  S  R  L  S  Q  C  Q  L  V  M  *  H  M  V  L  I  L  K  R
     -   *  A  A  C  H  N  A  N  W  L  C  D  T  W  F  *  S  *  R  G
4561 - GCTGCGCGCTGTATGCGTTCTCTTAAAGCTCCTGCCGTAGTGTCAGTATCATCACCAGAT - 4620
     - A  A  R  C  M  R  S  L  K  A  P  A  V  V  S  V  S  S  P  D
     -  L  R  A  V  C  V  L  L  K  L  L  P  *  C  Q  Y  H  H  Q  M
     -   C  A  L  Y  A  F  S  *  S  S  C  R  S  V  S  I  I  T  R  C
4621 - GCTGTTACTACATATAATGGATACCTCACTTCGTCATCAAAGACATCTGAGGAGCACTTT - 4680
     - A  V  T  T  Y  N  G  Y  L  T  S  S  S  K  T  S  E  E  H  F
     -  L  L  L  H  I  M  D  T  S  L  R  H  Q  R  H  L  R  S  T  L
     -   C  Y  Y  I  *  W  I  P  H  F  V  I  K  D  I  *  G  A  L  C
4681 - GTAGAAACAGTTTCTTTGGCTGGCTCTTACAGAGATTGGTCCTATTCAGGACAGCGTACA - 4740
     - V  E  T  V  S  L  A  G  S  Y  R  D  W  S  Y  S  G  Q  R  T
     -  *  K  Q  F  L  W  L  A  L  T  E  I  G  P  I  Q  D  S  V  Q
     -   R  N  S  F  F  G  W  L  L  Q  R  L  V  L  F  R  T  A  Y  R
4741 - GAGTTAGGTGTTGAATTTCTTAAGCGTGGTGACAAAATTGTGTACCACACTCTGGAGAGC - 4800
     - E  L  G  V  E  F  L  K  R  G  D  K  I  V  Y  H  T  L  E  S
     -  S  *  V  L  N  F  L  S  V  V  T  K  L  C  T  T  L  W  R  A
     -   V  R  C  *  I  S  *  A  W  *  Q  N  C  V  P  H  S  G  E  P
4801 - CCCGTCGAGTTTCATCTTGACGGTGAGGTTCTTTCACTTGACAAACTAAAGAGTCTCTTA - 4860
     - P  V  E  F  H  L  D  G  E  V  L  S  L  D  K  L  K  S  L  L
     -  P  S  S  F  I  L  T  V  R  F  F  H  L  T  N  *  R  V  S  Y
     -   R  R  V  S  S  *  R  *  G  S  F  T  *  Q  T  K  E  S  L  I
4861 - TCCCTGCGGGAGGTTAAGACTATAAAAGTGTTCACAACTGTGGACAACACTAATCTCCAC - 4920
     - S  L  R  E  V  K  T  I  K  V  F  T  T  V  D  N  T  N  L  H
     -  P  C  G  R  L  R  L  *  K  C  S  Q  L  W  T  T  L  I  S  T
     -   P  A  G  G  *  D  Y  K  S  V  H  N  C  G  Q  H  *  S  P  H
4921 - ACACAGCTTGTGGATATGTCTATGACATATGGACAGCAGTTTGGTCCAACATACTTGGAT - 4980
     - T  Q  L  V  D  M  S  M  T  Y  G  Q  Q  F  G  P  T  Y  L  D
     -  H  S  L  W  I  C  L  *  H  M  D  S  S  L  V  Q  H  T  W  M
     -   T  A  C  G  Y  V  V  Y  D  I  W  T  A  V  W  S  N  I  L  G  W
4981 - GGTGCTGATGTTACAAAAATTAAACCTCATGTAAATCATGAGGGTAAGACTTTCTTTGTA - 5040
     - G  A  D  V  T  K  I  K  P  H  V  N  H  E  G  K  T  F  F  V
     -  V  L  M  L  Q  K  L  N  L  M  *  I  M  R  V  R  L  S  L  Y
     -   C  *  C  Y  K  N  *  T  S  C  K  S  *  G  *  D  F  L  C  T
5041 - CTACCTAGTGATGACACACTACGTAGTGAAGCTTTCGAGTACTACCATACTCTTGATGAG - 5100
     - L  P  S  D  D  T  L  R  S  E  A  F  E  Y  Y  H  T  L  D  E
     -  Y  L  V  M  T  H  Y  V  V  K  L  S  S  T  T  I  L  L  M  R
     -   T  *  *  *  H  T  T  *  *  S  F  R  V  L  P  Y  S  *  *  E
5101 - AGTTTTCTTGGTAGGTACATGTCTGCTTTAAACCACACAAAGAAATGGAAATTTCCTCAA - 5160
     - S  F  L  G  R  Y  M  S  A  L  N  H  T  K  K  W  K  F  P  Q
     -  V  F  L  V  G  T  C  L  L  *  T  T  Q  R  N  G  N  F  L  K
     -   F  S  W  *  V  H  V  C  F  K  P  H  K  E  M  E  I  S  S  S
5161 - GTTGGTGGTTTAACTTCAATTAAATGGGCTGATAACAATTGTTATTTGTCTAGTGTTTTA - 5220
     - V  G  G  L  T  S  I  K  W  A  D  N  N  C  Y  L  S  S  V  L
     -  L  V  V  *  L  Q  L  N  G  L  I  T  I  V  I  C  L  V  F  Y
     -   W  W  F  N  F  N  *  M  G  *  *  Q  L  L  F  V  *  C  F  I
5221 - TTAGCACTTCAACAGCTTGAAGTCAAATTCAATGCACCAGCACTTCAAGAGGCTTATTAT - 5280
     - L  A  L  Q  Q  L  E  V  K  F  N  A  P  A  L  Q  E  A  Y  Y
     -  *  H  F  N  S  L  K  S  N  S  M  H  Q  H  F  K  R  L  I  I
     -   S  T  S  T  A  *  S  Q  I  Q  C  T  S  T  S  R  G  L  L  *
5281 - AGAGCCCGTGCTGGTGATGCTGCTAACTTTTGTGCACTCATACTCGCTTACAGTAATAAA - 5340
     - R  A  R  A  G  D  A  A  N  F  C  A  L  I  L  A  Y  S  N  K
     -  E  P  V  L  V  M  L  L  T  F  V  H  S  Y  S  L  T  V  I  K
     -   S  P  C  W  *  C  C  *  L  L  C  T  H  T  R  L  Q  *  *  N
5341 - ACTGTTGGCGAGCTTGGTGATGTCAGAGAAACTATGACCCATCTTCTACAGCATGCTAAT - 5400
     - T  V  G  E  L  G  D  V  R  E  T  M  T  H  L  L  Q  H  A  N
     -  L  L  A  S  L  V  M  S  E  K  L  *  P  I  F  Y  S  M  L  I
     -   C  W  R  A  W  *  C  Q  R  N  Y  D  P  S  S  T  A  C  *  F
```

FIG. 4 Cont'd

```
5401 - TTGGAATCTGCAAAGCGAGTTCTTAATGTGGTGTGTAAACATTGTGGTCAGAAAACTACT - 5460
     - L  E  S  A  K  R  V  L  N  V  V  C  K  H  C  G  Q  K  T  T
     -  W  N  L  Q  S  E  F  L  M  W  C  V  N  I  V  V  R  K  L  L
     -   G  I  C  K  A  S  S  *  C  G  V  *  T  L  W  S  E  N  Y  Y
5461 - ACCTTAACGGTGTAGAAGCTGTGATGTATATGGGTACTCTATCTTATGATAATCTTAAG - 5520
     - T  L  T  G  V  E  A  V  M  Y  M  G  T  L  S  Y  D  N  L  K
     -  P  *  R  V  *  K  L  *  C  I  W  V  L  Y  L  M  I  I  L  R
     -   L  N  G  C  R  S  C  D  V  Y  G  Y  S  I  L  *  *  S  *  D
5521 - ACAGGTGTTTCCATTCCATGTGTGTGTGGTCGTGATGCTACACAATATCTAGTACAACAA - 5580
     - T  G  V  S  I  P  C  V  C  G  R  D  A  T  Q  Y  L  V  Q  Q
     -  Q  V  F  P  F  H  V  C  V  V  V  M  L  H  N  I  *  Y  N  K
     -   R  C  F  H  S  M  C  V  W  S  *  C  Y  T  I  S  S  T  T  R
5581 - GAGTCTTCTTTTGTTATGATGTCTGCACCACCTGCTGAGTATAAATTACAGCAAGGTACA - 5640
     - E  S  S  F  V  M  M  S  A  P  P  A  E  Y  K  L  Q  Q  G  T
     -  S  L  L  L  *  C  L  H  H  L  L  S  I  N  Y  S  K  V  H
     -   V  F  F  C  Y  D  V  C  T  T  C  *  V  *  I  T  A  R  Y  I
5641 - TTCTTATGTGCGAATGAGTACACTGGTAACTATCAGTGTGGTCATTACACTCATATAACT - 5700
     - F  L  C  A  N  E  Y  T  G  N  Y  Q  C  G  H  Y  T  H  I  T
     -  S  Y  V  R  M  S  T  L  V  T  I  S  V  V  I  T  L  I  *  L
     -   L  M  C  E  *  V  H  W  *  L  S  V  W  S  L  H  S  Y  N  C
5701 - GCTAAGGAGACCCTCTATCGTATTGACGGAGCTCACCTTACAAAGATGTCAGAGTACAAA - 5760
     - A  K  E  T  L  Y  R  I  D  G  A  H  L  T  K  M  S  E  Y  K
     -  L  R  R  P  S  I  V  L  T  E  L  T  L  Q  R  C  Q  S  T  K
     -   *  G  D  P  L  S  Y  *  R  S  S  P  Y  K  D  V  R  V  Q  R
5761 - GGACCAGTGACTGATGTTTTCTACAAGGAAACATCTTACACTACAACCATCAAGCCTGTG - 5820
     - G  P  V  T  D  V  F  Y  K  E  T  S  Y  T  T  T  I  K  P  V
     -  D  Q  *  L  M  F  S  T  R  K  H  L  T  L  Q  P  S  S  L  C
     -   T  S  D  *  C  F  L  Q  G  N  I  L  H  Y  N  H  Q  A  C  V
5821 - TCGTATAAACTCGATGGAGTTACTTACACAGAGATTGAACCAAAATTGGATGGGTATTAT - 5880
     - S  Y  K  L  D  G  V  T  Y  T  E  I  E  P  K  L  D  G  Y  Y
     -  R  I  N  S  M  E  L  L  T  Q  R  L  N  Q  N  W  M  G  I  I
     -   V  *  T  R  W  S  Y  L  H  R  D  *  T  K  I  G  W  V  L  *
5881 - AAAAAGGATAATGCTTACTATACAGAGCAGCCTATAGACCTTGTACCAACTCAACCATTA - 5940
     - K  K  D  N  A  Y  Y  T  E  Q  P  I  D  L  V  P  T  Q  P  L
     -  K  R  I  M  L  T  I  Q  S  S  L  *  T  L  Y  Q  L  N  H  Y
     -   K  G  *  C  L  L  Y  R  A  A  Y  R  P  C  T  N  S  T  I  T
5941 - CCAAATGCGAGTTTTGATAATTTCAAACTCACATGTTCTAACACAAAATTTGCTGATGAT - 6000
     - P  N  A  S  F  D  N  F  K  L  T  C  S  N  T  K  F  A  D  D
     -  Q  M  R  V  L  I  I  S  N  S  H  V  L  T  Q  N  L  L  M  I
     -   K  C  E  F  *  *  F  Q  T  H  M  F  *  H  K  I  C  *  *  F
6001 - TTAAATCAAATGACAGGCTTCACAAAGCCAGCTTCACGAGAGCTATCTGTCACATTCTTC - 6060
     - L  N  Q  M  T  G  F  T  K  P  A  S  R  E  L  S  V  T  F  F
     -  *  I  K  *  Q  A  S  Q  S  Q  L  H  E  S  Y  L  S  H  S  S
     -   K  S  N  D  R  L  H  K  A  S  F  T  R  A  I  C  H  I  L  P
6061 - CCAGACTTGAATGGCGATGTAGTGGCTATTGACTATAGACACTATTCAGCGAGTTTCAAG - 6120
     - P  D  L  N  G  D  V  V  A  I  D  Y  R  H  Y  S  A  S  F  K
     -  Q  T  *  M  A  M  *  W  L  L  T  I  D  T  I  Q  R  V  S  R
     -   R  L  E  W  R  C  S  G  Y  *  L  *  T  L  F  S  E  F  Q  E
6121 - AAAGGTGCTAAATTACTGCATAAGCCAATTGTTTGGCACATTAACCAGGCTACAACCAAG - 6180
     - K  G  A  K  L  L  H  K  P  I  V  W  H  I  N  Q  A  T  T  K
     -  K  V  L  N  Y  C  I  S  Q  L  F  G  T  L  T  R  L  Q  P  R
     -   R  C  *  I  T  A  *  A  N  C  L  A  H  *  P  G  Y  N  Q  D
6181 - ACAACGTTCAAACCAAACACTTGGTGTTTACGTTGTCTTTGGAGTACAAAGCCAGTAGAT - 6240
     - T  T  F  K  P  N  T  W  C  L  R  C  L  W  S  T  K  P  V  D
     -  Q  R  S  N  Q  T  L  G  V  Y  V  V  F  G  V  Q  S  Q  *  I
     -   N  V  Q  T  K  H  L  V  F  T  L  S  L  E  Y  K  A  S  R  Y
6241 - ACTTCAAATTCATTTGAAGTTCTGGCAGTAGAAGACACACAAGGAATGGACAATCTTGCT - 6300
     - T  S  N  S  F  E  V  L  A  V  E  D  T  Q  G  M  D  N  L  A
     -  L  Q  I  H  L  K  F  W  Q  *  K  T  H  K  E  W  T  I  L  L
     -   F  K  F  I  *  S  S  G  S  R  R  H  T  R  N  G  Q  S  C  L
```

FIG. 4 Cont'd

```
6301 - TGTGAAAGTCAACAACCCACCTCTGAAGAAGTAGTGGAAAATCCTACCATACAGAAGGAA - 6360
     -  C E S Q Q P T S E E V V E N P T I Q K E
     -   V K V N N P P L K K * W K I L P Y R R K
     -    * K S T T H L * R S S G K S Y H T E G S
6361 - GTCATAGAGTGTGACGTGAAAACTACCGAAGTTGTAGGCAATGTCATACTTAAACCATCA - 6420
     -  V I E C D V K T T E V V G N V I L K P S
     -   S * S V T * K L P K L * A M S Y L N H Q
     -    H R V * R E N Y R S C R Q C H T * T I R
6421 - GATGAAGGTGTTAAAGTAACACAAGAGTTAGGTCATGAGGATCTTATGGCTGCTTATGTG - 6480
     -  D E G V K V T Q E L G H E D L M A A Y V
     -   M K V L K * H K S * V M R I L W L L M W
     -    * R C * S N T R V R S * G S Y G C L C G
6481 - GAAAACACAAGCATTACCATTAAGAAACCTAATGAGCTTTCACTAGCCTTAGGTTTAAAA - 6540
     -  E N T S I T I K K P N E L S L A L G L K
     -   K T Q A L P L R N L M S F H * P * V * K
     -    K H K H Y H * E T * * A F T S L R F K N
6541 - ACAATTGCCACTCATGGTATTGCTGCAATTAATAGTGTTCCTTGGAGTAAAATTTTGGCT - 6600
     -  T I A T H G I A A I N S V P W S K I L A
     -   Q L P L M V L L Q L I V F L G V K F W L
     -    N C H S W Y C C N * * C S L E * N F G L
6601 - TATGTCAAACCATTCTTAGGACAAGCAGCAATTACAACATCAAATTGCGCTAAGAGATTA - 6660
     -  Y V K P F L G Q A A I T T S N C A K R L
     -   M S N H S * D K Q Q L Q H Q I A L R D *
     -    C Q T I L R T S S N Y N I K L R * E I S
6661 - GCACAACGTGTGTTTAACAATTATATGCCTTATGTGTTTACATTATTGTTCCAATTGTGT - 6720
     -  A Q R V F N N Y M P Y V F T L L F Q L C
     -   H N V C L T I I C L M C L H Y C S N C V
     -    T T C V * Q L Y A L C V Y I I V P I V Y
6721 - ACTTTTACTAAAAGTACCAATTCTAGAATTAGAGCTTCACTACCTACAACTATTGCTAAA - 6780
     -  T F T K S T N S R I R A S L P T T I A K
     -   L L L K V P I L E L E L H Y L Q L L L K
     -    F Y * K Y Q F * N * S F T T Y N Y C * K
6781 - AATAGTGTTAAGAGTGTTGCTAAATTATGTTTGGATGCCGGCATTAATTATGTGAAGTCA - 6840
     -  N S V K S V A K L C L D A G I N Y V K S
     -   I V L R V L L N Y V W M P A L I M * S H
     -    * C * E C C * I M F G C R H * L C E V T
6841 - CCCAAATTTTCTAAATTGTTCACAATCGCTATGTGGCTATTGTTGTTAAGTATTTGCTTA - 6900
     -  P K F S K L F T I A M W L L L L S I C L
     -   P N F L N C S Q S L C G Y C C * V F A *
     -    Q I F * I V H N R Y V A I V V K Y L L R
6901 - GGTTCTCTAATCTGTGTAACTGCTGCTTTTGGTGTACTCTTATCTAATTTTGGTGCTCCT - 6960
     -  G S L I C V T A A F G V L L S N F G A P
     -   V L * S V * L L L L V Y S Y L I L V L L
     -    F S N L C N C C F W C T L I * F W C S F
6961 - TCTTATTGTAATGGCGTTAGAGAATTGTATCTTAATTCGTCTAACGTTACTACTATGGAT - 7020
     -  S Y C N G V R E L Y L N S S N V T T M D
     -   L I V M A L E N C I L I R L T L L L W I
     -    L L * W R * R I V S * F V * R Y Y Y G F
7021 - TTCTGTGAAGGTTCTTTTCCTTGCAGCATTTGTTTAAGTGGATTAGACTCCCTTGATTCT - 7080
     -  F C E G S F P C S I C L S G L D S L D S
     -   S V K V L F L A A F V * V D * T P L I L
     -    L * R F F S L Q H L F K W I R L P * F L
7081 - TATCCAGCTCTTGAAACCATTCAGGTGACGATTTCATCGTACAAGCTAGACTTGACAATT - 7140
     -  Y P A L E T I Q V T I S S Y K L D L T I
     -   I Q L L K P F R * R F H R T S * T * Q F
     -    S S S * N H S G D D F I V Q A R L D N F
7141 - TTAGGTCTGGCCGCTGAGTGGGTTTTGGCATATATGTTGTTCACAAAATTCTTTTATTTA - 7200
     -  L G L A A E W V L A Y M L F T K F F Y L
     -   * V W P L S G F W H I C C S Q N S F I Y
     -    R S G R * V G F G I Y V V H K I L L F I
```

FIG. 4 Cont'd

```
7201 - TTAGGTCTTTCAGCTATAATGCAGGTGTTCTTTGGCTATTTTGCTAGTCATTTCATCAGC - 7260
     -   L  G  L  S  A  I  M  Q  V  F  F  G  Y  F  A  S  H  F  I  S
     -  *  V  F  Q  L  *  C  R  C  S  L  A  I  L  L  V  I  S  S  A
     -   R  S  F  S  Y  N  A  G  V  L  W  L  F  C  *  S  F  H  Q  Q
7261 - AATTCTTGGCTCATGTGGTTTATCATTAGTATTGTACAAATGGCACCCGTTTCTGCAATG - 7320
     -   N  S  W  L  M  W  F  I  I  S  I  V  Q  M  A  P  V  S  A  M
     -   I  L  G  S  C  G  L  S  L  V  L  Y  K  W  H  P  F  L  Q  W
     -   F  L  A  H  V  V  Y  H  *  Y  C  T  N  G  T  R  F  C  N  G
7321 - GTTAGGATGTACATCTTCTTTGCTTCTTTCTACTACATATGGAAGAGCTATGTTCATATC - 7380
     -   V  R  M  Y  I  F  F  A  S  F  Y  Y  I  W  K  S  Y  V  H  I
     -   L  G  C  T  S  S  L  L  L  S  T  T  Y  G  R  A  M  F  I  S
     -  *  D  V  H  L  L  C  F  F  L  L  H  M  E  E  L  C  S  Y  H
7381 - ATGGATGGTTGCACCTCTTCGACTTGCATGATGTGCTATAAGCGCAATCGTGCCACACGC - 7440
     -   M  D  G  C  T  S  S  T  C  M  M  C  Y  K  R  N  R  A  T  R
     -   W  M  V  A  P  L  R  L  A  *  C  A  I  S  A  I  V  P  H  A
     -   G  W  L  H  L  F  D  L  H  D  V  L  *  A  Q  S  C  H  T  R
7441 - GTTGAGTGTACAACTATTGTTAATGGCATGAAGAGATCTTTCTATGTCTATGCAAATGGA - 7500
     -   V  E  C  T  T  I  V  N  G  M  K  R  S  F  Y  V  Y  A  N  G
     -   L  S  V  Q  L  L  L  M  A  *  R  D  L  S  M  S  M  Q  M  E
     -  *  V  Y  N  Y  C  *  W  H  E  E  I  F  L  C  L  C  K  W  R
7501 - GGCCGTGGCTTCTGCAAGACTCACAATTGGAATTGTCTCAATTGTGACACATTTTGCACT - 7560
     -   G  R  G  F  C  K  T  H  N  W  N  C  L  N  C  D  T  F  C  T
     -   A  V  A  S  A  R  L  T  I  G  I  V  S  I  V  T  H  F  A  L
     -   P  W  L  L  Q  D  S  Q  L  E  L  S  Q  L  *  H  I  L  H  W
7561 - GGTAGTACATTCATTAGTGATGAAGTTGCTCGTGATTTGTCACTCCAGTTTAAAAGACCA - 7620
     -   G  S  T  F  I  S  D  E  V  A  R  D  L  S  L  Q  F  K  R  P
     -   V  V  H  S  L  V  M  K  L  L  V  I  C  H  S  S  L  K  D  Q
     -  *  Y  I  H  *  *  *  S  C  S  *  F  V  T  P  V  *  K  T  N
7621 - ATCAACCCTACTGACCAGTCATCGTATATTGTTGATAGTGTTGCTGTGAAAAATGGCGCG - 7680
     -   I  N  P  T  D  Q  S  S  Y  I  V  D  S  V  A  V  K  N  G  A
     -   S  T  L  L  T  S  H  R  I  L  L  I  V  L  L  *  K  M  A  R
     -   Q  P  Y  *  P  V  I  V  Y  C  *  *  C  C  C  E  K  W  R  A
7681 - CTTCACCTCTACTTTGACAAGGCTGGTCAAAAGACCTATGAGAGACATCCTCTCTCCCAT - 7740
     -   L  H  L  Y  F  D  K  A  G  Q  K  T  Y  E  R  H  P  L  S  H
     -   F  T  S  T  L  T  R  L  V  K  R  P  M  R  D  I  L  S  P  I
     -   S  P  L  L  *  Q  G  W  S  K  D  L  *  E  T  S  S  L  P  F
7741 - TTTGTCAATTTAGACAATTTGAGAGCTAACAACACTAAAGGTTCACTGCCTATTAATGTC - 7800
     -   F  V  N  L  D  N  L  R  A  N  N  T  K  G  S  L  P  I  N  V
     -   L  S  I  *  T  I  *  E  L  T  T  L  K  V  H  C  L  L  M  S
     -   C  Q  F  R  Q  F  E  S  *  Q  H  *  R  F  T  A  Y  *  C  H
7801 - ATAGTTTTTGATGGCAAGTCCAAATGCGACGAGTCTGCTTCTAAGTCTGCTTCTGTGTAC - 7860
     -   I  V  F  D  G  K  S  K  C  D  E  S  A  S  K  S  A  S  V  Y
     -  *  F  L  M  A  S  P  N  A  T  S  L  L  L  S  L  L  L  C  T
     -   S  F  *  W  Q  V  Q  M  R  R  V  C  F  *  V  C  F  C  V  L
7861 - TACAGTCAGCTGATGTGCCAACCTATTCTGTTGCTTGACCAAGCTCTTGTATCAGACGTT - 7920
     -   Y  S  Q  L  M  C  Q  P  I  L  L  L  D  Q  A  L  V  S  D  V
     -   T  V  S  *  C  A  N  L  F  C  C  L  T  K  L  L  Y  Q  T  L
     -   Q  S  A  D  V  P  T  Y  S  V  A  *  P  S  S  C  I  R  R  W
7921 - GGAGATAGTACTGAAGTTTCCGTTAAGATGTTTGATGCTTATGTCGACACCTTTTCAGCA - 7980
     -   G  D  S  T  E  V  S  V  K  M  F  D  A  Y  V  D  T  F  S  A
     -   E  I  V  L  K  F  P  L  R  C  L  M  L  S  M  T  P  F  Q  Q
     -   R  *  Y  *  S  F  R  *  D  V  *  C  L  C  R  H  L  F  S  N
7981 - ACTTTTAGTGTTCCTATGGAAAAACTTAAGGCACTTGTTGCTACAGCTCACAGCGAGTTA - 8040
     -   T  F  S  V  P  M  E  K  L  K  A  L  V  A  T  A  H  S  E  L
     -   L  L  V  F  L  W  K  N  L  R  H  L  L  L  Q  L  T  A  S  *
     -   F  *  C  S  Y  G  K  T  *  G  T  C  C  Y  S  S  Q  R  V  S
8041 - GCAAAGGGTGTAGCTTTAGATGGTGTCCTTTCTACATTCGTGTCAGCTGCCCGACAAGGT - 8100
     -   A  K  G  V  A  L  D  G  V  L  S  T  F  V  S  A  A  R  Q  G
     -   Q  R  V  *  L  *  M  V  S  F  L  H  S  C  Q  L  P  D  K  V
     -   K  G  C  S  F  R  W  C  P  F  Y  I  R  V  S  C  P  T  R  C
```

FIG. 4 Cont'd

```
8101 - GTTGTTGATACCGATGTTGACACAAAGGATGTTATTGAATGTCTCAAACTTTCACATCAC - 8160
     - V  V  D  T  D  V  D  T  K  D  V  I  E  C  L  K  L  S  H  H
     -  L  L  I  P  M  L  T  Q  R  M  L  L  N  V  S  N  F  H  I  T
     -   C  *  Y  R  C  *  H  K  G  C  Y  *  M  S  Q  T  F  T  S  L
8161 - TCTGACTTAGAAGTGACAGGTGACAGTTGTAACAATTTCATGCTCACCTATAATAAGGTT - 8220
     - S  D  L  E  V  T  G  D  S  C  N  N  F  M  L  T  Y  N  K  V
     -  L  T  *  K  *  Q  V  T  V  V  T  I  S  C  S  P  I  I  R  L
     -   *  L  R  S  D  R  *  Q  L  *  Q  F  H  A  H  L  *  *  G  *
8221 - GAAAACATGACGCCCAGAGATCTTGGCGCATGTATTGACTGTAATGCAAGGCATATCAAT - 8280
     - E  N  M  T  P  R  D  L  G  A  C  I  D  C  N  A  R  H  I  N
     -  K  T  *  R  P  E  I  L  A  H  V  L  T  V  M  Q  G  I  S  M
     -   K  H  D  A  Q  R  S  W  R  M  Y  *  L  *  C  K  A  Y  Q  C
8281 - GCCCAAGTAGCAAAAAGTCACAATGTTTCACTCATCTGGAATGTAAAAGACTACATGTCT - 8340
     - A  Q  V  A  K  S  H  N  V  S  L  I  W  N  V  K  D  Y  M  S
     -  P  K  *  Q  K  V  T  M  F  H  S  S  G  M  *  K  T  T  C  L
     -   P  S  S  K  K  S  Q  C  F  T  H  L  E  C  K  R  L  H  V  F
8341 - TTATCTGAACAGCTGCGTAAACAAATTCGTAGTGCTGCCAAGAAGAACAACATACCTTTT - 8400
     - L  S  E  Q  L  R  K  Q  I  R  S  A  A  K  K  N  N  I  P  F
     -  Y  L  N  S  C  V  N  K  F  V  V  L  P  R  R  T  T  Y  L  L
     -   I  *  T  A  A  *  T  N  S  *  C  C  Q  E  E  Q  H  T  F  *
8401 - AGACTAACTTGTGCTACAACTAGACAGGTTGTCAATGTCATAACTACTAAAATCTCACTC - 8460
     - R  L  T  C  A  T  T  R  Q  V  V  N  V  I  T  T  K  I  S  L
     -  D  *  L  V  L  Q  L  D  R  L  S  M  S  *  L  L  K  S  H  S
     -   T  N  L  C  Y  N  *  T  G  C  Q  C  H  N  Y  *  N  L  T  Q
8461 - AAGGGTGGTAAGATTGTTAGTACTTGTTTTAAACTTATGCTTAAGGCCACATTATTGTGC - 8520
     - K  G  G  K  I  V  S  T  C  F  K  L  M  L  K  A  T  L  L  C
     -  R  V  V  R  L  L  V  L  V  L  N  L  C  L  R  P  H  Y  C  A
     -   G  W  *  D  C  *  Y  L  F  *  T  Y  A  *  G  H  I  I  V  R
8521 - GTTCTTGCTGCATTGGTTTGTTATATCGTTATGCCAGTACATACATTGTCAATCCATGAT - 8580
     - V  L  A  A  L  V  C  Y  I  V  M  P  V  H  T  L  S  I  H  D
     -  F  L  L  H  W  F  V  I  S  L  C  Q  Y  I  H  C  Q  S  M  M
     -   S  C  C  I  G  L  L  Y  R  Y  A  S  T  Y  I  V  N  P  *  W
8581 - GGTTACACAAATGAAATCATTGGTTACAAAGCCATTCAGGATGGTGTCACTCGTGACATC - 8640
     - G  Y  T  N  E  I  I  G  Y  K  A  I  Q  D  G  V  T  R  D  I
     -  V  T  Q  M  K  S  L  V  T  K  P  F  R  M  V  S  L  V  T  S
     -   L  H  K  *  N  H  W  L  Q  S  H  S  G  W  C  H  S  *  H  H
8641 - ATTTCTACTGATGATTGTTTTGCAAATAAACATGCTGGTTTTGACGCATGGTTTAGCCAG - 8700
     - I  S  T  D  D  C  F  A  N  K  H  A  G  F  D  A  W  F  S  Q
     -  F  L  L  M  I  V  L  Q  I  N  M  L  V  L  T  H  G  L  A  S
     -   F  Y  *  *  L  F  C  K  *  T  C  W  F  *  R  M  V  *  P  A
8701 - CGTGGTGGTTCATACAAAAATGACAAAAGCTGCCCTGTAGTAGCTGCTATCATTACAAGA - 8760
     - R  G  G  S  Y  K  N  D  K  S  C  P  V  V  A  A  I  I  T  R
     -  V  V  V  H  T  K  M  T  K  A  A  L  *  *  L  L  S  L  Q  E
     -   W  W  F  I  Q  K  *  Q  K  L  P  C  S  S  C  Y  H  Y  K  R
8761 - GAGATTGGTTTCATAGTGCCTGGCTTACCGGGTACTGTGCTGAGAGCAATCAATGGTGAC - 8820
     - E  I  G  F  I  V  P  G  L  P  G  T  V  L  R  A  I  N  G  D
     -  R  L  V  S  *  C  L  A  Y  R  V  L  C  *  E  Q  S  M  V  T
     -   D  W  F  H  S  A  W  L  T  G  Y  C  A  E  S  N  Q  W  *  L
8821 - TTCTTGCATTTTCTACCTCGTGTTTTTAGTGCTGTTGGCAACATTTGCTACACACCTTCC - 8880
     - F  L  H  F  L  P  R  V  F  S  A  V  G  N  I  C  Y  T  P  S
     -  S  C  I  F  Y  L  V  F  L  V  L  L  A  T  F  A  T  H  L  P
     -   L  A  F  S  T  S  C  F  *  C  C  W  Q  H  L  L  H  T  F  Q
8881 - AAACTCATTGAGTATAGTGATTTTGCTACCTCTGCTTGCGTTCTTGCTGCTGAGTGTACA - 8940
     - K  L  I  E  Y  S  D  F  A  T  S  A  C  V  L  A  A  E  C  T
     -  N  S  L  S  I  V  I  L  L  P  L  L  A  F  L  L  L  S  V  Q
     -   T  H  *  V  *  *  F  C  Y  L  C  L  R  S  C  C  *  V  Y  N
8941 - ATTTTTAAGGATGCTATGGGCAAACCTGTGCCATATTGTTATGACACTAATTTGCTAGAG - 9000
     - I  F  K  D  A  M  G  K  P  V  P  Y  C  Y  D  T  N  L  L  E
     -  F  L  R  M  L  W  A  N  L  C  H  I  V  M  T  L  I  C  *  R
     -   F  *  G  C  Y  G  Q  T  C  A  I  L  L  *  H  *  F  A  R  G
```

FIG. 4 Cont'd

```
9001 - GGTTCTATTTCTTATAGTGAGCTTCGTCCAGACACTCGTTATGTGCTTATGGATGGTTCC - 9060
      -  G  S  I  S  Y  S  E  L  R  P  D  T  R  Y  V  L  M  D  G  S
      -    V  L  F  L  I  V  S  F  V  Q  T  L  V  M  C  L  W  M  V  P
      -      F  Y  F  L  *  *  A  S  S  R  H  S  L  C  A  Y  G  W  F  H
9061 - ATCATACAGTTCCTAACACTTACCTGGAGGGTTCTGTTAGAGTAGTAACAACTTTTGAT - 9120
      -  I  I  Q  F  P  N  T  Y  L  E  G  S  V  R  V  V  T  T  F  D
      -    S  Y  S  F  L  T  L  T  W  R  V  L  L  E  *  *  Q  L  L  M
      -      H  T  V  S  *  H  L  P  G  G  F  C  *  S  S  N  N  F  *  C
9121 - GCTGAGTACTGTAGACATGGTACATGCGAAAGGTCAGAAGTAGGTATTTGCCTATCTACC - 9180
      -  A  E  Y  C  R  H  G  T  C  E  R  S  E  V  G  I  C  L  S  T
      -    L  S  T  V  D  M  V  H  A  K  G  Q  K  *  V  F  A  Y  L  P
      -      *  V  L  *  T  W  Y  M  R  K  V  R  S  R  Y  L  P  I  Y  Q
9181 - AGTGGTAGATGGGTTCTTAATAATGAGCATTACAGAGCTCTATCAGGAGTTTTCTGTGGT - 9240
      -  S  G  R  W  V  L  N  N  E  H  Y  R  A  L  S  G  V  F  C  G
      -    V  V  D  G  F  L  I  M  S  I  T  E  L  Y  Q  E  F  S  V  V
      -      W  *  M  G  S  *  *  *  A  L  Q  S  S  I  R  S  F  L  W  C
9241 - GTTGATGCGATGAATCTCATAGCTAACATCTTTACTCCTCTTGTGCAACCTGTGGGTGCT - 9300
      -  V  D  A  M  N  L  I  A  N  I  F  T  P  L  V  Q  P  V  G  A
      -    L  M  R  *  I  S  *  L  T  S  L  L  L  C  N  L  W  V  L
      -      *  C  D  E  S  H  S  *  H  L  Y  S  S  C  A  T  C  G  C  F
9301 - TTAGATGTGTCTGCTTCAGTAGTGGCTGGTGGTATTATTGCCATATTGGTGACTTGTGCT - 9360
      -  L  D  V  S  A  S  V  V  A  G  G  I  I  A  I  L  V  T  C  A
      -    *  M  C  L  L  Q  *  W  L  V  V  L  L  P  Y  W  *  L  V  L
      -      R  C  V  C  F  S  S  G  W  W  Y  Y  C  H  I  G  D  L  C  C
9361 - GCCTACTACTTTATGAAATTCAGACGTGCTTTTGGTGAGTACAACCATGTTGTTGCTGCT - 9420
      -  A  Y  Y  F  M  K  F  R  R  A  F  G  E  Y  N  H  V  V  A  A
      -    P  T  T  L  *  N  S  D  V  L  L  V  S  T  T  M  L  L  L  L
      -      L  L  L  Y  E  I  Q  T  C  F  W  *  V  Q  P  C  C  C  C  *
9421 - AATGCACTTTTGTTTTTGATGTCTTTCACTATACTCTGTCTGGCACCAGCTTACAGCTTT - 9480
      -  N  A  L  L  F  L  M  S  F  T  I  L  C  L  A  P  A  Y  S  F
      -    M  H  F  C  F  *  C  L  S  L  Y  S  V  W  H  Q  L  T  A  F
      -      C  T  F  V  F  D  V  F  H  Y  T  L  S  G  T  S  L  Q  L  S
9481 - CTGCCGGGAGTCTACTCAGTCTTTTACTTGTACTTGACATTCTATTTCACCAATGATGTT - 9540
      -  L  P  G  V  Y  S  V  F  Y  L  Y  L  T  F  Y  F  T  N  D  V
      -    C  R  E  S  T  Q  S  F  T  C  T  *  H  S  I  S  P  M  M  F
      -      A  G  S  L  L  S  L  L  L  V  L  D  I  L  F  H  Q  *  C  F
9541 - TCATTCTTGGCTCACCTTCAATGGTTTGCCATGTTTTCTCCTATTGTGCCTTTTTGGATA - 9600
      -  S  F  L  A  H  L  Q  W  F  A  M  F  S  P  I  V  P  F  W  I
      -    H  S  W  L  T  F  N  G  L  P  C  F  L  L  L  C  L  F  G  *
      -      I  L  G  S  P  S  M  V  C  H  V  F  S  Y  C  A  F  L  D  N
9601 - ACAGCAATCTATGTATTCTGTATTTCTCTGAAGCACTGCCATTGGTTCTTTAACAACTAT - 9660
      -  T  A  I  Y  V  F  C  I  S  L  K  H  C  H  W  F  F  N  N  Y
      -    Q  Q  S  M  Y  S  V  F  L  *  S  T  A  I  G  S  L  T  T  I
      -      S  N  L  C  I  L  Y  F  S  E  A  L  P  L  V  L  *  Q  L  S
9661 - CTTAGGAAAAGAGTCATGTTTAATGGAGTTACATTTAGTACCTTCGAGGAGGCTGCTTTG - 9720
      -  L  R  K  R  V  M  F  N  G  V  T  F  S  T  F  E  E  A  A  L
      -    L  G  K  E  S  C  L  M  E  L  H  L  V  P  S  R  R  L  L  C
      -      *  E  K  S  H  V  *  W  S  Y  I  *  Y  L  R  G  G  C  F  V
9721 - TGTACCTTTTTGCTCAACAAGGAAATGTACCTAAAATTGCGTAGCGAGACACTGTTGCCA - 9780
      -  C  T  F  L  L  N  K  E  M  Y  L  K  L  R  S  E  T  L  L  P
      -    V  P  F  C  S  T  R  K  C  T  *  N  C  V  A  R  H  C  C  H
      -      Y  L  F  A  Q  Q  G  N  V  P  K  I  A  *  R  D  T  V  A  T
9781 - CTTACACAGTATAACAGGTATCTTGCTCTATATAACAAGTACAAGTATTTCAGTGGAGCC - 9840
      -  L  T  Q  Y  N  R  Y  L  A  L  Y  N  K  Y  K  Y  F  S  G  A
      -    L  H  S  I  T  G  I  L  L  Y  I  T  S  T  S  I  S  V  E  P
      -      Y  T  V  *  Q  V  S  C  S  I  *  Q  V  Q  V  F  Q  W  S  L
9841 - TTAGATACTACCAGCTATCGTGAAGCAGCTTGCTGCCACTTAGCAAAGGCTCTAAATGAC - 9900
      -  L  D  T  T  S  Y  R  E  A  A  C  C  H  L  A  K  A  L  N  D
      -    *  I  L  P  A  I  V  K  Q  L  A  A  T  *  Q  R  L  *  M  T
      -      R  Y  Y  Q  L  S  *  S  S  L  L  P  L  S  K  G  S  K  *  L
```

FIG. 4 Cont'd

```
9901  - TTTAGCAACTCAGGTGCTGATGTTCTCTACCAACCACCACAGACATCAATCACTTCTGCT  - 9960
      -  F  S  N  S  G  A  D  V  L  Y  Q  P  P  Q  T  S  I  T  S  A
      -  L  A  T  Q  V  L  M  F  S  T  N  H  H  R  H  Q  S  L  L  L
      -  *  Q  L  R  C  *  C  S  L  P  T  T  T  D  I  N  H  F  C  C
9961  - GTTCTGCAGAGTGGTTTTAGGAAAATGGCATTCCCGTCAGGCAAAGTTGAAGGGTGCATG  - 10020
      -  V  L  Q  S  G  F  R  K  M  A  F  P  S  G  K  V  E  G  C  M
      -  F  C  R  V  V  L  G  K  W  H  S  R  Q  A  K  L  K  G  A  W
      -  S  A  E  W  F  *  E  N  G  I  P  V  R  Q  S  *  R  V  H  G
10021 - GTACAAGTAACCTGTGGAACTACAACTCTTAATGGATTGTGGTTGGATGACACAGTATAC - 10080
      -  V  Q  V  T  C  G  T  T  T  L  N  G  L  W  L  D  D  T  V  Y
      -  Y  K  *  P  V  E  L  Q  L  L  M  D  C  G  W  M  T  Q  Y  T
      -  T  S  N  L  W  N  Y  N  S  *  W  I  V  V  G  *  H  S  I  L
10081 - TGTCCAAGACATGTCATTTGCACAGCAGAAGACATGCTTAATCCTAACTATGAAGATCTG - 10140
      -  C  P  R  H  V  I  C  T  A  E  D  M  L  N  P  N  Y  E  D  L
      -  V  Q  D  M  S  F  A  Q  Q  K  T  C  L  I  L  T  M  K  I  C
      -  S  K  T  C  H  L  H  S  R  R  H  A  *  S  *  L  *  R  S  A
10141 - CTCATTCGCAAATCCAACCATAGCTTTCTTGTTCAGGCTGGCAATGTTCAACTTCGTGTT - 10200
      -  L  I  R  K  S  N  H  S  F  L  V  Q  A  G  N  V  Q  L  R  V
      -  S  F  A  N  P  T  I  A  F  L  F  R  L  A  M  F  N  F  V  L
      -  H  S  Q  I  Q  P  *  L  S  C  S  G  W  Q  C  S  T  S  C  Y
10201 - ATTGGCCATTCTATGCAAAATTGTCTGCTTAGGCTTAAAGTTGATACTTCTAACCCTAAG - 10260
      -  I  G  H  S  M  Q  N  C  L  L  R  L  K  V  D  T  S  N  P  K
      -  L  A  I  L  C  K  I  V  C  L  G  L  K  L  I  L  L  T  L  R
      -  W  P  F  Y  A  K  L  S  A  *  A  *  S  *  Y  F  *  P  *  D
10261 - ACACCCAAGTATAAATTTGTCCGTATCCAACCTGGTCAAACATTTTCAGTTCTAGCATGC - 10320
      -  T  P  K  Y  K  F  V  R  I  Q  P  G  Q  T  F  S  V  L  A  C
      -  H  P  S  I  N  L  S  V  S  N  L  V  K  H  F  Q  F  *  H  A
      -  T  Q  V  *  I  C  P  Y  P  T  W  S  N  I  F  S  S  S  M  L
10321 - TACAATGGTTCACCATCTGGTGTTTATCAGTGTGCCATGAGACCTAATCATACCATTAAA - 10380
      -  Y  N  G  S  P  S  G  V  Y  Q  C  A  M  R  P  N  H  T  I  K
      -  T  M  V  H  H  L  V  F  I  S  V  P  *  D  L  I  I  P  L  K
      -  Q  W  F  T  I  W  C  L  S  V  C  H  E  T  *  S  Y  H  *  R
10381 - GGTTCTTTCCTTAATGGATCATGTGGTAGTGTTGGTTTTAACATTGATTATGATTGCGTG - 10440
      -  G  S  F  L  N  G  S  C  G  S  V  G  F  N  I  D  Y  D  C  V
      -  V  L  S  L  M  D  H  V  V  V  L  V  L  T  L  I  M  I  A  C
      -  F  F  P  *  W  I  M  W  *  C  W  F  *  H  *  L  *  L  R  V
10441 - TCTTTCTGCTATATGCATCATATGGAGCTTCCAACAGGAGTACACGCTGGTACTGACTTA - 10500
      -  S  F  C  Y  M  H  H  M  E  L  P  T  G  V  H  A  G  T  D  L
      -  L  S  A  I  C  I  I  W  S  F  Q  Q  E  Y  T  L  V  L  T  *
      -  F  L  L  Y  A  S  Y  G  A  S  N  R  S  T  R  W  Y  *  L  R
10501 - GAAGGTAAATTCTATGGTCCATTTGTTGACAGACAAACTGCACAGGCTGCAGGTACAGAC - 10560
      -  E  G  K  F  Y  G  P  F  V  D  R  Q  T  A  Q  A  A  G  T  D
      -  K  V  N  S  M  V  H  L  L  T  D  K  L  H  R  L  Q  V  Q  T
      -  R  *  I  L  W  S  I  C  *  Q  T  N  C  T  G  C  R  Y  R  H
10561 - ACAACCATAACATTAAATGTTTTGGCATGGCTGTATGCTGCTGTTATCAATGGTGATAGG - 10620
      -  T  T  I  T  L  N  V  L  A  W  L  Y  A  A  V  I  N  G  D  R
      -  Q  P  *  H  *  M  F  W  H  G  C  M  L  L  L  S  M  V  I  G
      -  N  H  N  I  K  C  F  G  M  A  V  C  C  C  Y  Q  W  *  *  V
10621 - TGGTTTCTTAATAGATTCACCACTACTTTGAATGACTTTAACCTTGTGGCAATGAAGTAC - 10680
      -  W  F  L  N  R  F  T  T  T  L  N  D  F  N  L  V  A  M  K  Y
      -  G  F  L  I  D  S  P  L  L  *  M  T  L  T  L  W  Q  *  S  T
      -  V  S  *  *  I  H  H  Y  F  E  *  L  *  P  C  G  N  E  V  Q
10681 - AACTATGAACCTTTGACACAAGATCATGTTGACATATTGGGACCTCTTTCTGCTCAAACA - 10740
      -  N  Y  E  P  L  T  Q  D  H  V  D  I  L  G  P  L  S  A  Q  T
      -  T  M  N  L  *  H  K  I  M  L  T  Y  W  D  L  F  L  L  K  Q
      -  L  *  T  F  D  T  R  S  C  *  H  I  G  T  S  F  C  S  N  R
10741 - GGAATTGCCGTCTTAGATATGTGTGCTGCTTTGAAAGAGCTGCTGCAGAATGGTATGAAT - 10800
      -  G  I  A  V  L  D  M  C  A  A  L  K  E  L  L  Q  N  G  M  N
      -  E  L  P  S  *  I  C  V  L  L  *  K  S  C  C  R  M  V  *  M
      -  N  C  R  L  R  Y  V  C  C  F  E  R  A  A  A  E  W  Y  E  W
```

FIG. 4 Cont'd

```
10801 - GGTCGTACTATCCTTGGTAGCACTATTTTAGAAGATGAGTTTACACCATTTGATGTTGTT - 10860
      - G  R  T  I  L  G  S  T  I  L  E  D  E  F  T  P  F  D  V  V
      - V  V  L  S  L  V  A  L  F  *  K  M  S  L  H  H  L  M  L  L
      - S  Y  Y  P  W  *  H  Y  F  R  R  *  V  Y  T  I  *  C  C  *
10861 - AGACAATGCTCTGGTGTTACCTTCCAAGGTAAGTTCAAGAAAATTGTTAAGGGCACTCAT - 10920
      - R  Q  C  S  G  V  T  F  Q  G  K  F  K  K  I  V  K  G  T  H
      - D  N  A  L  V  L  P  S  K  V  S  S  R  K  L  L  R  A  L  I
      - T  M  L  W  C  Y  L  P  R  *  V  Q  E  N  C  *  G  H  S  S
10921 - CATTGGATGCTTTTAACTTTCTTGACATCACTATTGATTCTTGTTCAAAGTACACAGTGG - 10980
      - H  W  M  L  L  T  F  L  T  S  L  L  I  L  V  Q  S  T  Q  W
      - I  G  C  F  *  L  S  *  H  H  Y  *  F  L  F  K  V  H  S  G
      - L  D  A  F  N  F  L  D  I  T  I  D  S  C  S  K  Y  T  V  V
10981 - TCACTGTTTTTCTTTGTTTACGAGAATGCTTTCTTGCCATTTACTCTTGGTATTATGGCA - 11040
      - S  L  F  F  F  V  Y  E  N  A  F  L  P  F  T  L  G  I  M  A
      - H  C  F  S  L  F  T  R  M  L  S  C  H  L  L  L  V  L  W  Q
      - T  V  F  L  C  L  R  E  C  F  L  A  I  Y  S  W  Y  Y  G  N
11041 - ATTGCTGCATGTGCTATGCTGCTTGTTAAGCATAAGCACGCATTCTTGTGCTTGTTTCTG - 11100
      - I  A  A  C  M  L  L  V  K  H  K  H  A  F  L  C  L  F  L
      - L  L  H  V  L  C  C  L  L  S  I  S  T  H  S  C  A  C  F  C
      - C  C  M  C  Y  A  A  C  *  A  *  A  R  I  L  V  L  V  S  V
11101 - TTACCTTCTCTTGCAACAGTTGCTTACTTTAATATGGTCTACATGCCTGCTAGCTGGGTG - 11160
      - L  P  S  L  A  T  V  A  Y  F  N  M  V  Y  M  P  A  S  W  V
      - Y  L  L  L  Q  Q  L  L  T  L  I  W  S  T  C  L  L  A  G  *
      - T  F  S  C  N  S  C  L  L  *  Y  G  L  H  A  C  *  L  G  D
11161 - ATGCGTATCATGACATGGCTTGAATTGGCTGACACTAGCTTGTCTGGTTATAGGCTTAAG - 11220
      - M  R  I  M  T  W  L  E  L  A  D  T  S  L  S  G  Y  R  L  K
      - C  V  S  *  H  G  L  N  W  L  T  L  A  C  L  V  I  G  L  R
      - A  Y  H  D  M  A  *  I  G  *  H  *  L  V  W  L  *  A  *  G
11221 - GATTGTGTTATGTATGCTTCAGCTTTAGTTTTGCTTATTCTCATGACAGCTCGCACTGTT - 11280
      - D  C  V  M  Y  A  S  A  L  V  L  L  I  L  M  T  A  R  T  V
      - I  V  L  C  M  L  Q  L  *  F  C  L  F  S  *  Q  L  A  L  F
      - L  C  Y  V  C  F  S  F  S  F  A  Y  S  H  D  S  S  H  C  L
11281 - TATGATGATGCTGCTAGACGTGTTTGGACACTGATGAATGTCATTACACTTGTTTACAAA - 11340
      - Y  D  D  A  A  R  R  V  W  T  L  M  N  V  I  T  L  V  Y  K
      - M  M  M  L  L  D  V  F  G  H  *  *  M  S  L  H  L  F  T  K
      - *  *  C  C  *  T  C  L  D  T  D  E  C  H  Y  T  C  L  Q  S
11341 - GTCTACTATGGTAATGCTTTAGATCAAGCTATTTCCATGTGGGCCTTAGTTATTTCTGTA - 11400
      - V  Y  Y  G  N  A  L  D  Q  A  I  S  M  W  A  L  V  I  S  V
      - S  T  M  V  M  L  *  I  K  L  F  P  C  G  P  *  L  F  L  *
      - L  L  W  *  C  F  R  S  S  Y  F  H  V  G  L  S  Y  F  C  N
11401 - ACCTCTAACTATTCTGGTGTCGTTACGACTATCATGTTTTTAGCTAGAGCTATAGTGTTT - 11460
      - T  S  N  Y  S  G  V  V  T  T  I  M  F  L  A  R  A  I  V  F
      - P  L  T  I  L  V  S  L  R  L  S  C  F  *  L  E  L  *  C  L
      - L  *  L  F  W  C  R  Y  D  Y  H  V  F  S  *  S  Y  S  V  C
11461 - GTGTGTGTTGAGTATTACCCATTGTTATTTATTACTGGCAACACCTTACAGTGTATCATG - 11520
      - V  C  V  E  Y  Y  P  L  L  F  I  T  G  N  T  L  Q  C  I  M
      - C  V  L  S  I  T  H  C  Y  L  L  A  T  P  Y  S  V  S  C
      - V  C  *  V  L  P  I  V  I  Y  Y  W  Q  H  L  T  V  Y  H  A
11521 - CTTGTTTATTGTTTCTTAGGCTATTGTTGCTGCTGCTACTTTGGCCTTTTCTGTTTACTC - 11580
      - L  V  Y  C  F  L  G  Y  C  C  C  C  Y  F  G  L  F  C  L  L
      - L  F  I  V  S  *  A  I  V  A  A  A  T  L  A  F  S  V  Y  S
      - C  L  L  F  L  R  L  L  L  L  L  L  W  P  F  L  F  T  Q
11581 - AACCGTTACTTCAGGCTTACTCTTGGTGTTTATGACTACTTGGTCTCTACACAAGAATTT - 11640
      - N  R  Y  F  R  L  T  L  G  V  Y  D  Y  L  V  S  T  Q  E  F
      - T  V  T  S  G  L  L  L  V  F  M  T  T  W  S  L  H  K  N  L
      - P  L  L  Q  A  Y  S  W  C  L  *  L  L  G  L  Y  T  R  I  *
11641 - AGGTATATGAACTCCCAGGGGCTTTTGCCTCCTAAGAGTAGTATTGATGCTTTCAAGCTT - 11700
      - R  Y  M  N  S  Q  G  L  L  P  P  K  S  S  I  D  A  F  K  L
      - G  I  *  T  P  R  G  F  C  L  L  R  V  V  L  M  L  S  S  L
      - V  Y  E  L  P  G  A  F  A  S  *  E  *  Y  *  C  F  Q  A  *
```

FIG. 4 Cont'd

```
11701 - AACATTAAGTTGTTGGGTATTGGAGGTAAACCATGTATCAAGGTTGCTACTGTACAGTCT - 11760
       - N  I  K  L  L  G  I  G  G  K  P  C  I  K  V  A  T  V  Q  S
       -  T  L  S  C  W  V  L  E  V  N  H  V  S  R  L  L  L  Y  S  L
       -   H  *  V  V  G  Y  W  R  *  T  M  Y  Q  G  C  Y  C  T  V  *
11761 - AAAATGTCTGACGTAAAGTGCACATCTGTGGTACTGCTCTCGGTTCTTCAACAACTTAGA - 11820
       - K  M  S  D  V  K  C  T  S  V  V  L  L  S  V  L  Q  Q  L  R
       -  K  C  L  T  *  S  A  H  L  W  Y  C  S  R  F  F  N  N  L  E
       -   N  V  *  R  K  V  H  I  C  G  T  A  L  G  S  S  T  T  *  S
11821 - GTAGAGTCATCTTCTAAATTGTGGGCACAATGTGTACAACTCCACAATGATATTCTTCTT - 11880
       - V  E  S  S  S  K  L  W  A  Q  C  V  Q  L  H  N  D  I  L  L
       -  *  S  H  L  L  N  C  G  H  N  V  Y  N  S  T  M  I  F  F  L
       -   R  V  I  F  *  I  V  G  T  M  C  T  T  P  Q  *  Y  S  S  C
11881 - GCAAAAGACACAACTGAAGCTTTCGAGAAGATGGTTTCTCTTTTGTCTGTTTTGCTATCC - 11940
       - A  K  D  T  T  E  A  F  E  K  M  V  S  L  L  S  V  L  L  S
       -  Q  K  T  Q  L  K  L  S  R  R  W  F  L  F  C  L  F  C  Y  P
       -   K  R  H  N  *  S  F  R  E  D  G  F  S  F  V  C  F  A  I  H
11941 - ATGCAGGGTGCTGTAGACATTAATAGGTTGTGCGAGGAAATGCTCGATAACCGTGCTACT - 12000
       - M  Q  G  A  V  D  I  N  R  L  C  E  E  M  L  D  N  R  A  T
       -  C  R  V  L  *  T  L  I  G  C  A  R  K  C  S  I  T  V  L  L
       -   A  G  C  C  R  H  *  *  V  V  R  G  N  A  R  *  P  C  Y  S
12001 - CTTCAGGCTATTGCTTCAGAATTTAGTTCTTTACCATCATATGCCGCTTATGCCACTGCC - 12060
       - L  Q  A  I  A  S  E  F  S  S  L  P  S  Y  A  A  Y  A  T  A
       -  F  R  L  L  L  Q  N  L  V  L  Y  H  H  M  P  L  M  P  L  P
       -   S  G  Y  C  F  R  I  *  F  F  T  I  I  C  R  L  C  H  C  P
12061 - CAGGAGGCCTATGAGCAGGCTGTAGCTAATGGTGATTCTGAAGTCGTTCTCAAAAAGTTA - 12120
       - Q  E  A  Y  E  Q  A  V  A  N  G  D  S  E  V  V  L  K  K  L
       -  R  R  P  M  S  R  L  *  L  M  V  I  L  K  S  F  S  K  S  *
       -   G  G  L  *  A  G  C  S  *  W  *  F  *  S  R  S  Q  K  V  K
12121 - AAGAAATCTTTGAATGTGGCTAAATCTGAGTTTGACCGTGATGCTGCCATGCAACGCAAG - 12180
       - K  K  S  L  N  V  A  K  S  E  F  D  R  D  A  A  M  Q  R  K
       -  R  N  L  *  M  W  L  N  L  S  L  T  V  M  L  P  C  N  A  S
       -   E  I  F  E  C  G  *  I  *  V  *  P  *  C  C  H  A  T  Q  V
12181 - TTGGAAAAGATGGCAGATCAGGCTATGACCCAAATGTACAAACAGGCAAGATCTGAGGAC - 12240
       - L  E  K  M  A  D  Q  A  M  T  Q  M  Y  K  Q  A  R  S  E  D
       -  W  K  R  W  Q  I  R  L  *  P  K  C  T  N  R  Q  D  L  R  T
       -   G  K  D  G  R  S  G  Y  D  P  N  V  Q  T  G  K  I  *  G  Q
12241 - AAGAGGGCAAAAGTAACTAGTGCTATGCAAACAATGCTCTTCACTATGCTTAGGAAGCTT - 12300
       - K  R  A  K  V  T  S  A  M  Q  T  M  L  F  T  M  L  R  K  L
       -  R  G  Q  K  *  L  V  L  C  K  Q  C  S  S  L  C  L  G  S  L
       -   E  G  K  S  N  *  C  Y  A  N  N  A  L  H  Y  A  *  E  A  *
12301 - GATAATGATGCACTTAACAACATTATCAACAATGCGCGTGATGGTTGTGTTCCACTCAAC - 12360
       - D  N  D  A  L  N  N  I  I  N  N  A  R  D  G  C  V  P  L  N
       -  I  M  M  H  L  T  T  L  S  T  M  R  V  M  V  V  F  H  S  T
       -   *  *  C  T  *  Q  H  Y  Q  Q  C  A  *  W  L  C  S  T  Q  H
12361 - ATCATACCATTGACTACAGCAGCCAAACTCATGGTTGTTGTCCCTGATTATGGTACCTAC - 12420
       - I  I  P  L  T  T  A  A  K  L  M  V  V  V  P  D  Y  G  T  Y
       -  S  Y  H  *  L  Q  Q  P  N  S  W  L  L  S  L  I  M  V  P  T
       -   H  T  I  D  Y  S  S  Q  T  H  G  C  C  P  *  L  W  Y  L  Q
12421 - AAGAACACTTGTGATGGTAACACCTTTACATATGCATCTGCACTCTGGGAAATCCAGCAA - 12480
       - K  N  T  C  D  G  N  T  F  T  Y  A  S  A  L  W  E  I  Q  Q
       -  R  T  L  V  M  V  T  P  L  H  M  H  L  S  G  K  S  S  K
       -   E  H  L  *  W  *  H  L  Y  I  C  I  C  T  L  G  N  P  A  S
12481 - GTTGTTGATGCGGATAGCAAGATTGTTCAACTTAGTGAAATTAACATGGACAATTCACCA - 12540
       - V  V  D  A  D  S  K  I  V  Q  L  S  E  I  N  M  D  N  S  P
       -  L  L  M  R  I  A  R  L  F  N  L  V  K  L  T  W  T  I  H  Q
       -   C  *  C  G  *  Q  D  C  S  T  *  *  N  *  H  G  Q  F  T  K
12541 - AATTTGGCTTGGCCTCTTATTGTTACAGCTCTAAGAGCCAACTCAGCTGTTAAACTACAG - 12600
       - N  L  A  W  P  L  I  V  T  A  L  R  A  N  S  A  V  K  L  Q
       -  I  W  L  G  L  L  L  L  Q  L  *  E  P  T  Q  L  L  N  Y  R
       -   F  G  L  A  S  Y  C  Y  S  S  K  S  Q  L  S  C  *  T  T  E
```

FIG. 4 Cont'd

```
12601 - AATAATGAACTGAGTCCAGTAGCACTACGACAGATGTCCTGTGCGGCTGGTACCACACAA - 12660
      -  N  N  E  L  S  P  V  A  L  R  Q  M  S  C  A  A  G  T  T  Q
      -  I  M  N  *  V  Q  *  H  Y  D  R  C  P  V  R  L  V  P  H  K
      -  *  *  T  E  S  S  S  T  T  T  D  V  L  C  G  W  Y  H  T  N
12661 - ACAGCTTGTACTGATGACAATGCACTTGCCTACTATAACAATTCGAAGGGAGGTAGGTTT - 12720
      -  T  A  C  T  D  D  N  A  L  A  Y  Y  N  N  S  K  G  G  R  F
      -  Q  L  V  L  M  T  M  H  L  P  T  I  T  I  R  R  E  V  G  L
      -  S  L  Y  *  *  Q  C  T  C  L  L  *  Q  F  E  G  R  *  V  C
12721 - GTGCTGGCATTACTATCAGACCACCAAGATCTCAAATGGGCTAGATTCCCTAAGAGTGAT - 12780
      -  V  L  A  L  L  S  D  H  Q  D  L  K  W  A  R  F  P  K  S  D
      -  C  W  H  Y  Y  Q  T  T  K  I  S  N  G  L  D  S  L  R  V  M
      -  A  G  I  T  I  R  P  P  R  S  Q  M  G  *  I  P  *  E  *  W
12781 - GGTACAGGTACAATTTACACAGAACTGGAACCACCTTGTAGGTTTGTTACAGACACACCA - 12840
      -  G  T  G  T  I  Y  T  E  L  P  P  C  R  F  V  T  D  T  P
      -  V  Q  V  Q  F  T  Q  N  W  N  H  L  V  G  L  L  Q  T  H  Q
      -  Y  R  Y  N  L  H  R  T  G  T  T  L  *  V  C  Y  R  H  T  K
12841 - AAAGGGCCTAAAGTGAAATACTTGTACTTCATCAAAGGCTTAAACAACCTAAATAGAGGT - 12900
      -  K  G  P  K  V  K  Y  L  Y  F  I  K  G  L  N  N  L  N  R  G
      -  K  G  L  K  *  N  T  C  T  S  S  K  A  *  T  T  *  I  E  V
      -  R  A  *  S  E  I  L  V  L  H  Q  R  L  K  Q  P  K  *  R  Y
12901 - ATGGTGCTGGGCAGTTTAGCTGCTACAGTACGTCTTCAGGCTGGAAATGCTACAGAAGTA - 12960
      -  M  V  L  G  S  L  A  A  T  V  R  L  Q  A  G  N  A  T  E  V
      -  W  C  W  A  V  *  L  L  Q  Y  V  F  R  L  E  M  L  Q  K  Y
      -  G  A  G  Q  F  S  C  Y  S  T  S  S  G  W  K  C  Y  R  S  T
12961 - CCTGCCAATTCAACTGTGCTTTCCTTCTGTGCTTTTGCAGTAGACCCTGCTAAAGCATAT - 13020
      -  P  A  N  S  T  V  L  S  F  C  A  F  A  V  D  P  A  K  A  Y
      -  L  P  I  Q  L  C  F  P  S  V  L  L  Q  *  T  L  L  K  H  I
      -  C  Q  F  N  C  A  F  L  L  C  F  C  S  R  P  C  *  S  I  *
13021 - AAGGATTACCTAGCAAGTGGAGGACAACCAATCACCAACTGTGTGAAGATGTTGTGTACA - 13080
      -  K  D  Y  L  A  S  G  G  Q  P  I  T  N  C  V  K  M  L  C  T
      -  R  I  T  *  Q  V  E  D  N  Q  S  P  T  V  *  R  C  C  V  H
      -  G  L  P  S  K  W  R  T  T  N  H  Q  L  C  E  D  V  V  Y  T
13081 - CACACTGGTACAGGACAGGCAATTACTGTAACACCAGAAGCTAACATGGACCAAGAGTCC - 13140
      -  H  T  G  T  G  Q  A  I  T  V  T  P  E  A  N  M  D  Q  E  S
      -  T  L  V  Q  D  R  Q  L  L  *  H  Q  K  L  T  W  T  K  S  P
      -  H  W  Y  R  T  G  N  Y  C  N  T  R  S  *  H  G  P  R  V  L
13141 - TTTGGTGGTGCTTCATGTTGTCTGTATTGTAGATGCCACATTGACCATCCAAATCCTAAA - 13200
      -  F  G  G  A  S  C  C  L  Y  C  R  C  H  I  D  H  P  N  P  K
      -  L  V  V  L  H  V  V  C  I  V  D  A  T  L  T  I  Q  I  L  K
      -  W  W  C  F  M  L  S  V  L  *  M  P  H  *  P  S  K  S  *  R
13201 - GGATTCTGTGACTTGAAAGGTAAGTACGTCCAAATACCTACCACTTGTGCTAATGACCCA - 13260
      -  G  F  C  D  L  K  G  K  Y  V  Q  I  P  T  T  C  A  N  D  P
      -  D  S  V  T  *  K  V  S  T  S  K  Y  L  P  L  V  L  M  T  Q
      -  I  L  *  L  E  R  *  V  R  P  N  T  Y  H  L  C  *  *  P  S
13261 - GTGGGTTTTACACTTAGAAACACAGTCTGTACCGTCTGCGGAATGTGGAAAGGTTATGGC - 13320
      -  V  G  F  T  L  R  N  T  V  C  T  V  C  G  M  W  K  G  Y  G
      -  W  V  L  H  L  E  T  Q  S  V  P  S  A  E  C  G  K  V  M  A
      -  G  F  Y  T  *  K  H  S  L  Y  R  L  R  N  V  E  R  L  W  L
13321 - TGTAGTTGTGACCAACTCCGCGAACCCTTGATGCAGTCTGCGGATGCATCAACGTTTTTA - 13380
      -  C  S  C  D  Q  L  R  E  P  L  M  Q  S  A  D  A  S  T  F  L
      -  V  V  V  T  N  S  A  N  P  *  C  S  L  R  M  H  Q  R  F  *
      -  *  L  *  P  T  P  R  T  L  D  A  V  C  G  C  I  N  V  F  K
13381 - AACGGGTTTGCGGTGTAAGTGCAGCCCGTCTTACACCGTGCGGCACAGGCACTAGTACTG - 13440
      -  N  G  F  A  V  *  V  Q  P  V  L  H  R  A  A  Q  A  L  V  L
      -  T  G  L  R  C  K  C  S  P  S  Y  T  V  R  H  R  H  *  Y  *
      -  R  V  C  G  V  S  A  A  R  L  T  P  C  G  T  G  T  S  T  D
13441 - ATGTCGTCTACAGGGCTTTTGATATTTACAACGAAAAAGTTGCTGGTTTTGCAAAGTTCC - 13500
      -  M  S  S  T  G  L  L  I  F  T  T  K  K  L  L  V  L  Q  S  S
      -  C  R  L  Q  G  F  *  Y  L  Q  R  K  S  C  W  F  C  K  V  P
      -  V  V  Y  R  A  F  D  I  Y  N  E  K  V  A  G  F  A  K  F  L
```

FIG. 4 Cont'd

```
13501 - TAAAAACTAATTGCTGTCGCTTCCAGGAGAAGGATGAGGAAGGCAATTTATTAGACTCTT - 13560
       - * K  L  I  A  V  A  S  R  R  R  M  R  K  A  I  Y  *  T  L
       -   K  N  *  L  L  S  L  P  G  E  G  *  G  R  Q  F  I  R  L  L
       -    K  T  N  C  C  R  F  Q  E  K  D  E  E  G  N  L  L  D  S  Y
13561 - ACTTTGTAGTTAAGAGGCATACTATGTCTAACTACCAACATGAAGAGACTATTTATAACT - 13620
       - T  L  *  L  R  G  I  L  C  L  T  T  N  M  K  R  L  F  I  T
       -   L  C  S  *  E  A  Y  Y  V  *  L  P  T  *  R  D  Y  L  *  L
       -    F  V  V  K  R  H  T  M  S  N  Y  Q  H  E  E  T  I  Y  N  L
13621 - TGGTTAAAGATTGTCCAGCGGTTGCTGTCCATGACTTTTTCAAGTTTAGAGTAGATGGTG - 13680
       - W  L  K  I  V  Q  R  L  L  S  M  T  F  S  S  L  E  *  M  V
       -   G  *  R  L  S  S  G  C  C  P  *  L  F  Q  V  *  S  R  W  *
       -    V  K  D  C  P  A  V  A  V  H  D  F  F  K  F  R  V  D  G  D
13681 - ACATGGTACCACATATATCACGTCAGCGTCTAACTAAATACACAATGGCTGATTTAGTCT - 13740
       - T  W  Y  H  I  Y  H  V  S  V  *  L  N  T  Q  W  L  I  *  S
       -   H  G  T  T  Y  I  T  S  A  S  N  *  I  H  N  G  *  F  S  L
       -    M  V  P  H  I  S  R  Q  R  L  T  K  Y  T  M  A  D  L  V  Y
13741 - ATGCTCTACGTCATTTTGATGAGGGTAATTGTGATACATTAAAAGAAATACTCGTCACAT - 13800
       - M  L  Y  V  I  L  M  R  V  I  V  I  H  *  K  K  Y  S  S  H
       -   C  S  T  S  F  *  *  G  *  L  *  Y  I  K  R  N  T  R  H  I
       -    A  L  R  H  F  D  E  G  N  C  D  T  L  K  E  I  L  V  T  Y
13801 - ACAATTGCTGTGATGATGATTATTTCAATAAGAAGGATTGGTATGACTTCGTAGAGAATC - 13860
       - T  I  A  V  M  M  I  I  S  I  R  R  I  G  M  T  S  *  R  I
       -   Q  L  L  *  *  *  L  F  Q  *  E  G  L  V  *  L  R  R  E  S
       -    N  C  C  D  D  D  Y  F  N  K  K  D  W  Y  D  F  V  E  N  P
13861 - CTGACATCTTACGCGTATATGCTAACTTAGGTGAGCGTGTACGCCAATCATTATTAAAGA - 13920
       - L  T  S  Y  A  Y  M  L  T  *  V  S  V  Y  A  N  H  Y  *  R
       -   *  H  L  T  R  I  C  *  L  R  *  A  C  T  P  I  I  I  K  D
       -    D  I  L  R  V  Y  A  N  L  G  E  R  V  R  Q  S  L  L  K  T
13921 - CTGTACAATTCTGCGATGCTATGCGTGATGCAGGCATTGTAGGCGTACTGACATTAGATA - 13980
       - L  Y  N  S  A  M  L  C  V  M  Q  A  L  *  A  Y  *  H  *  I
       -   C  T  I  L  R  C  Y  A  *  C  R  H  C  R  R  T  D  I  R  *
       -    V  Q  F  C  D  A  M  R  D  A  G  I  V  G  V  L  T  L  D  N
13981 - ATCAGGATCTTAATGGGAACTGGTACGATTTCGGTGATTTCGTACAAGTAGCACCAGGCT - 14040
       - I  R  I  L  M  G  T  G  T  I  S  V  I  S  Y  K  *  H  Q  A
       -   S  G  S  *  W  E  L  V  R  F  R  *  F  R  T  S  S  T  R  L
       -    Q  D  L  N  G  N  W  Y  D  F  G  D  F  V  Q  V  A  P  G  C
14041 - GCGGAGTTCCTATTGTGGATTCATATTACTCATTGCTGATGCCCATCCTCACTTTGACTA - 14100
       - A  E  F  L  L  W  I  H  I  T  H  C  *  C  P  S  S  L  *  L
       -   R  S  S  Y  C  G  F  I  L  L  I  A  D  A  H  P  H  F  D  *
       -    G  V  P  I  V  D  S  Y  Y  S  L  L  M  P  I  L  T  L  T  R
14101 - GGGCATTGGCTGCTGAGTCCCATATGGATGCTGATCTCGCAAAACCACTTATTAAGTGGG - 14160
       - G  H  W  L  L  S  P  I  W  M  L  I  S  Q  N  H  L  L  S  G
       -   G  I  G  C  *  V  P  Y  G  C  *  S  R  K  T  T  Y  *  V  G
       -    A  L  A  A  E  S  H  M  D  A  D  L  A  K  P  L  I  K  W  D
14161 - ATTTGCTGAAATATGATTTTACGGAAGAGAGACTTTGTCTCTTCGACCGTTATTTTAAAT - 14220
       - I  C  *  N  M  I  L  R  K  R  D  F  V  S  S  T  V  I  L  N
       -   F  A  E  I  *  F  Y  G  R  E  T  L  S  L  R  P  L  F  *  I
       -    L  L  K  Y  D  F  T  E  E  R  L  C  L  F  D  R  Y  F  K  Y
14221 - ATTGGGACCAGACATACCATCCCAATTGTATTAACTGTTTGGATGATAGGTGTATCCTTC - 14280
       - I  G  T  R  H  T  I  P  I  V  L  T  V  W  M  I  G  V  S  F
       -   L  G  P  D  I  P  S  Q  L  Y  *  L  F  G  *  *  V  Y  P  S
       -    W  D  Q  T  Y  H  P  N  C  I  N  C  L  D  D  R  C  I  L  H
14281 - ATTGTGCAAACTTTAATGTGTTATTTTCTACTGTGTTTCCACCTACAAGTTTTGGACCAC - 14340
       - I  V  Q  T  L  M  C  Y  F  L  L  C  F  H  L  Q  V  L  D  H
       -   L  C  K  L  *  C  V  I  F  Y  C  V  S  T  Y  K  F  W  T  T
       -    C  A  N  F  N  V  L  F  S  T  V  F  P  P  T  S  F  G  P  L
14341 - TAGTAAGAAAAATATTTGTAGATGGTGTTCCTTTTGTTGTTTCAACTGGATACCATTTTC - 14400
       - *  *  E  K  Y  L  *  M  V  F  L  L  L  F  Q  L  D  T  I  F
       -   S  K  K  N  I  C  R  W  C  S  F  C  C  F  N  W  I  P  F  S
       -    V  R  K  I  F  V  D  G  V  P  F  V  V  S  T  G  Y  H  F  R
```

FIG. 4 Cont'd

```
14401 - GTGAGTTAGGAGTCGTACATAATCAGGATGTAAACTTACATAGCTCGCGTCTCAGTTTCA - 14460
       - V S * E S Y I I R M * T Y I A R V S V S
       - * V R S R T * S G C K L T * L A S Q F Q
       - E L G V V H N Q D V N L H S S R L S F K
14461 - AGGAACTTTTAGTGTATGCTGCTGATCCAGCTATGCATGCAGCTTCTGGCAATTTATTGC - 14520
       - R N F * C M L L I Q L C M Q L L A I Y C
       - G T F S V C C * S S Y A C S F W Q F I A
       - E L L V Y A A D P A M H A A S G N L L L
14521 - TAGATAAACGCACTACATGCTTTTCAGTAGCTGCACTAACAAACAATGTTGCTTTTCAAA - 14580
       - * I N A L H A F Q * L H * Q T M L L F K
       - R * T H Y M L F S S C T N K Q C C F S N
       - D K R T T C F S V A A L T N N V A F Q T
14581 - CTGTCAAACCCGGTAATTTTAATAAAGACTTTTATGACTTTGCTGTGTCTAAAGGTTTCT - 14640
       - L S N P V I L I K T F M T L L C L K V S
       - C Q T R * F * * R L L * L C C V * R F L
       - V K P G N F N K D F Y D F A V S K G F F
14641 - TTAAGGAAGGAAGTTCTGTTGAACTAAAACACTTCTTCTTTGCTCAGGATGGCAACGCTG - 14700
       - L R K E V L L N * N T S S L L R M A T L
       - * G R K F C * T K T L L L C S G W Q R C
       - K E G S S V E L K H F F F A Q D G N A A
14701 - CTATCAGTGATTATGACTATTATCGTTATAATCTGCCAACAATGTGTGATATCAGACAAC - 14760
       - L S V I M T I I V I I C Q Q C V I S D N
       - Y Q * L * L L S L * S A N N V * Y Q T T
       - I S D Y D Y Y R Y N L P T M C D I R Q L
14761 - TCCTATTCGTAGTTGAAGTTGTTGATAAATACTTTGATTGTTACGATGGTGGCTGTATTA - 14820
       - S Y S * L K L L I N T L I V T M V A V L
       - P I R S * S C * * I L * L L R W W L Y *
       - L F V V E V V D K Y F D C Y D G G C I N
14821 - ATGCCAACCAAGTAATCGTTAACAATCTGGATAAATCAGCTGGTTTCCCATTTAATAAAT - 14880
       - M P T K * S L T I W I N Q L V S H L I N
       - C Q P S N R * Q S G * I S W F P I * * M
       - A N Q V I V N N L D K S A G F P F N K W
14881 - GGGGTAAGGCTAGACTTTATTATGACTCAATGAGTTATGAGGATCAAGATGCACTTTTCG - 14940
       - G V R L D F I M T Q * V M R I K M H F S
       - G * G * T L L * L N E L * G S R C T F R
       - G K A R L Y Y D S M S Y E D Q D A L F A
14941 - CGTATACTAAGCGTAATGTCATCCCTACTATAACTCAAATGAATCTTAAGTATGCCATTA - 15000
       - R I L S V M S S L L * L K * I L S M P L
       - V Y * A * C H P Y Y N S N E S * V C H *
       - Y T K R N V I P T I T Q M N L K Y A I S
15001 - GTGCAAAGAATAGAGCTCGCACCGTAGCTGGTGTCTCTATCTGTAGTACTATGACAAATA - 15060
       - V Q R I E L A P * L V S L S V V L * Q I
       - C K E * S S H R S W C L Y L * Y Y D K *
       - A K N R A R T V A G V S I C S T M T N R
15061 - GACAGTTTCATCAGAAATTATTGAAGTCAATAGCCGCCACTAGAGGAGCTACTGTGGTAA - 15120
       - D S F I R N Y * S Q * P P L E E L L W *
       - T V S S E I I E V N S R H * R S Y C G N
       - Q F H Q K L L K S I A A T R G A T V V I
15121 - TTGGAACAAGCAAGTTTTACGGTGGCTGGCATAATATGTTAAAAACTGTTTACAGTGATG - 15180
       - L E Q A S F T V A G I I C * K L F T V M
       - W N K Q V L R W L A * Y V K N C L Q * C
       - G T S K F Y G G W H N M L K T V Y S D V
15181 - TAGAAACTCCACACCTTATGGGTTGGGATTATCCAAAATGTGACAGAGCCATGCCTAACA - 15240
       - * K L H T L W V G I I Q N V T E P C L T
       - R N S T P Y G L G L S K M * Q S H A * H
       - E T P H L M G W D Y P K C D R A M P N M
15241 - TGCTTAGGATAATGGCCTCTCTTGTTCTTGCTCGCAAACATAACACTTGCTGTAACTTAT - 15300
       - C L G * W P L L F L L A N I T L A V T Y
       - A * D N G L S C S C S Q T * H L L * L I
       - L R I M A S L V L A R K H N T C C N L S
```

FIG. 4 Cont'd

```
15301 - CACACCGTTTCTACAGGTTAGCTAACGAGTGTGCGCAAGTATTAAGTGAGATGGTCATGT - 15360
       -  H  T  V  S  T  G  *  L  T  S  V  R  K  Y  *  V  R  W  S  C
       -    T  P  F  L  Q  V  S  *  R  V  C  A  S  I  K  *  D  G  H  V
       -      H  R  F  Y  R  L  A  N  E  C  A  Q  V  L  S  E  M  V  M  C
15361 - GTGGCGGCTCACTATATGTTAAACCAGGTGGAACATCATCCGGTGATGCTACAACTGCTT - 15420
       -  V  A  A  H  Y  M  L  N  Q  V  E  H  H  P  V  M  L  Q  L  L
       -    W  R  L  T  I  C  *  T  R  W  N  I  I  R  *  C  Y  N  C  L
       -      G  G  S  L  Y  V  K  P  G  G  T  S  S  G  D  A  T  T  A  Y
15421 - ATGCTAATAGTGTCTTTAACATTTGTCAAGCTGTTACAGCCAATGTAAATGCACTTCTTT - 15480
       -  M  L  I  V  S  L  T  F  V  K  L  L  Q  P  M  *  M  H  F  F
       -    C  *  *  C  L  *  H  L  S  S  C  Y  S  Q  C  K  C  T  S  F
       -      A  N  S  V  F  N  I  C  Q  A  V  T  A  N  V  N  A  L  L  S
15481 - CAACTGATGGTAATAAGATAGCTGACAAGTATGTCCGCAATCTACAACACAGGCTCTATG - 15540
       -  Q  L  M  V  I  R  *  L  T  S  M  S  A  I  Y  N  T  G  S  M
       -    N  *  W  *  *  D  S  *  Q  V  C  P  Q  S  T  T  Q  A  L  *
       -      T  D  G  N  K  I  A  D  K  Y  V  R  N  L  Q  H  R  L  Y  E
15541 - AGTGTCTCTATAGAAATAGGGATGTTGATCATGAATTCGTGGATGAGTTTTACGCTTACC - 15600
       -  S  V  S  I  E  I  G  M  L  I  M  N  S  W  M  S  F  T  L  T
       -    V  S  L  *  K  *  G  C  *  S  *  I  R  G  *  V  L  R  L  P
       -      C  L  Y  R  N  R  D  V  D  H  E  F  V  D  E  F  Y  A  Y  L
15601 - TGCGTAAACATTTCTCCATGATGATTCTTTCTGATGATGCCGTTGTGTGCTATAACAGTA - 15660
       -  C  V  N  I  S  P  *  *  F  F  L  M  M  P  L  C  A  I  T  V
       -    A  *  T  F  L  H  D  D  S  F  *  *  C  R  C  V  L  *  Q  *
       -      R  K  H  F  S  M  M  I  L  S  D  D  A  V  V  C  Y  N  S  N
15661 - ACTATGCGGCTCAAGGTTTAGTAGCTAGCATTAAGAACTTTAAGGCAGTTCTTTATTATC - 15720
       -  T  M  R  L  K  V  *  *  L  A  L  R  T  L  R  Q  F  F  I  I
       -    L  C  G  S  R  F  S  S  *  H  *  E  L  *  G  S  S  L  L  S
       -      Y  A  A  Q  G  L  V  A  S  I  K  N  F  K  A  V  L  Y  Y  Q
15721 - AAAATAATGTGTTCATGTCTGAGGCAAAATGTTGGACTGAGACTGACCTTACTAAAGGAC - 15780
       -  K  I  M  C  S  C  L  R  Q  N  V  G  L  R  L  T  L  L  K  D
       -    K  *  C  V  H  V  *  G  K  M  L  D  *  D  *  P  Y  *  R  T
       -      N  N  V  F  M  S  E  A  K  C  W  T  E  T  D  L  T  K  G  P
15781 - CTCACGAATTTTGCTCACAGCATACAATGCTAGTTAAACAAGGAGATGATTACGTGTACC - 15840
       -  L  T  N  F  A  H  S  I  Q  C  *  L  N  K  E  M  I  T  C  T
       -    S  R  I  L  L  T  A  Y  N  A  S  *  T  R  R  *  L  R  V  P
       -      H  E  F  C  S  Q  H  T  M  L  V  K  Q  G  D  D  Y  V  Y  L
15841 - TGCCTTACCCAGATCCATCAAGAATATTAGGCGCAGGCTGTTTTGTCGATGATATTGTCA - 15900
       -  C  L  T  Q  I  H  Q  E  Y  *  A  Q  A  V  L  S  M  I  L  S
       -    A  L  P  R  S  I  K  N  I  R  R  R  L  F  C  R  *  Y  C  Q
       -      P  Y  P  D  P  S  R  I  L  G  A  G  C  F  V  D  D  I  V  K
15901 - AAACAGATGGTACACTTATGATTGAAAGGTTCGTGTCACTGGCTATTGATGCTTACCCAC - 15960
       -  K  Q  M  V  H  L  *  L  K  G  S  C  H  W  L  L  M  L  T  H
       -    N  R  W  Y  T  Y  D  *  K  V  R  V  T  G  Y  *  C  L  P  T
       -      T  D  G  T  L  M  I  E  R  F  V  S  L  A  I  D  A  Y  P  L
15961 - TTACAAAACATCCTAATCAGGAGTATGCTGATGTCTTCACTTGTATTTACAATACATTA - 16020
       -  L  Q  N  I  L  I  R  S  M  L  M  S  F  T  C  I  Y  N  T  L
       -    Y  K  T  S  *  S  G  V  C  *  C  L  S  L  V  F  T  I  H  *
       -      T  K  H  P  N  Q  E  Y  A  D  V  F  H  L  Y  L  Q  Y  I  R
16021 - GAAAGTTACATGATGAGCTTACTGGCCACATGTTGGACATGTATTCCGTAATGCTAACTA - 16080
       -  E  S  Y  M  M  S  L  L  A  T  C  W  T  C  I  P  *  C  *  L
       -    K  V  T  *  *  A  Y  W  P  H  V  G  H  V  F  R  N  A  N  *
       -      K  L  H  D  E  L  T  G  H  M  L  D  M  Y  S  V  M  L  T  N
16081 - ATGATAACACCTCACGGTACTGGGAACCTGAGTTTTATGAGGCTATGTACACACCACATA - 16140
       -  M  I  T  P  H  G  T  G  N  L  S  F  M  R  L  C  T  H  H  I
       -    *  *  H  L  T  V  L  G  T  *  V  L  *  G  Y  V  H  T  T  Y
       -      D  N  T  S  R  Y  W  E  P  E  F  Y  E  A  M  Y  T  P  H  T
16141 - CAGTCTTGCAGGCTGTAGGTGCTTGTGTATTGTGCAATTCACAGACTTCACTTCGTTGCG - 16200
       -  Q  S  C  R  L  *  V  L  V  Y  C  A  I  H  R  L  H  F  V  A
       -    S  L  A  G  C  R  C  L  C  I  V  Q  F  T  D  F  T  S  L  R
       -      V  L  Q  A  V  G  A  C  V  L  C  N  S  Q  T  S  L  R  C  G
```

FIG. 4 Cont'd

```
16201 - GTGCCTGTATTAGGAGACCATTCCTATGTTGCAAGTGCTGCTATGACCATGTCATTTCAA - 16260
       - V  P  V  L  G  D  H  S  Y  V  A  S  A  A  M  T  M  S  F  Q
       - C  L  Y  *  E  T  I  P  M  L  Q  V  L  L  *  P  C  H  F  N
       -  A  C  I  R  R  P  F  L  C  C  K  C  C  Y  D  H  V  I  S  T
16261 - CATCACACAAATTAGTGTTGTCTGTTAATCCCTATGTTTGCAATGCCCCAGGTTGTGATG - 16320
       - H  H  T  N  *  C  C  L  L  I  P  M  F  A  M  P  Q  V  V  M
       - I  T  Q  I  S  V  V  C  *  S  L  C  L  Q  C  P  R  L  *  C
       -  S  H  K  L  V  L  S  V  N  P  Y  V  C  N  A  P  G  C  D  V
16321 - TCACTGATGTGACACAACTGTATCTAGGAGGTATGAGCTATTATTGCAAGTCACATAAGC - 16380
       - S  L  M  *  H  N  C  I  *  E  V  *  A  I  I  A  S  H  I  S
       - H  *  C  D  T  T  V  S  R  R  Y  E  L  L  L  L  Q  V  T  *  A
       -  T  D  V  T  Q  L  Y  L  G  G  M  S  Y  Y  C  K  S  H  K  P
16381 - CTCCCATTAGTTTTCCATTATGTGCTAATGGTCAGGTTTTTGGTTTATACAAAAACACAT - 16440
       - L  P  L  V  F  H  Y  V  L  M  V  R  F  L  V  Y  T  K  T  H
       - S  H  *  F  S  I  M  C  *  W  S  G  F  W  F  I  Q  K  H  M
       -  P  I  S  F  P  L  C  A  N  G  Q  V  F  G  L  Y  K  N  T  C
16441 - GTGTAGGCAGTGACAATGTCACTGACTTCAATGCGATAGCAACATGTGATTGGACTAATG - 16500
       - V  *  A  V  T  M  S  L  T  S  M  R  *  Q  H  V  I  G  L  M
       - C  R  Q  *  Q  C  H  *  L  Q  C  D  S  N  M  *  L  D  *  C
       -  V  G  S  D  N  V  T  D  F  N  A  I  A  T  C  D  W  T  N  A
16501 - CTGGCGATTACATACTTGCCAACACTTGTACTGAGAGACTCAAGCTTTTCGCAGCAGAAA - 16560
       - L  A  I  T  Y  L  P  T  L  V  L  R  D  S  S  F  S  Q  Q  K
       - W  R  L  H  T  C  Q  H  L  Y  *  E  T  Q  A  F  R  S  R  N
       -  G  D  Y  I  L  A  N  T  C  T  E  R  L  K  L  F  A  A  E  T
16561 - CGCTCAAAGCCACTGAGGAAACATTTAAGCTGTCATATGGTATTGCCACTGTACGCGAAG - 16620
       - R  S  K  P  L  R  K  H  L  S  C  H  M  V  L  P  L  Y  A  K
       - A  Q  S  H  *  G  N  I  *  A  V  I  W  Y  C  H  C  T  R  S
       -  L  K  A  T  E  E  T  F  K  L  S  Y  G  I  A  T  V  R  E  V
16621 - TACTCTCTGACAGAGAATTGCATCTTTCATGGAGGTTGGAAAACCTAGACCACCATTGA - 16680
       - Y  S  L  T  E  N  C  I  F  H  G  R  L  E  N  L  D  H  H  *
       - T  L  *  Q  R  I  A  S  F  M  G  G  W  K  T  *  T  T  I  E
       -  L  S  D  R  E  L  H  L  S  W  E  V  G  K  P  R  P  P  L  N
16681 - ACAGAAACTATGTCTTTACTGGTTACCGTGTAACTAAAAATAGTAAAGTACAGATTGGAG - 16740
       - T  E  T  M  S  L  L  V  T  V  *  L  K  I  V  K  Y  R  L  E
       - Q  K  L  C  L  Y  W  L  P  C  N  *  K  *  *  S  T  D  W  R
       -  R  N  Y  V  F  T  G  Y  R  V  T  K  N  S  K  V  Q  I  G  E
16741 - AGTACACCTTTGAAAAAGGTGACTATGGTGATGCTGTTGTGTACAGAGGTACTACGACAT - 16800
       - S  T  P  L  K  K  V  T  M  V  M  L  L  C  T  E  V  L  R  H
       - V  H  L  *  K  R  *  L  W  *  C  C  C  V  Q  R  Y  Y  D  I
       -  Y  T  F  E  K  G  D  Y  G  D  A  V  V  Y  R  G  T  T  T  Y
16801 - ACAAGTTGAATGTTGGTGATTACTTTGTGTTGACATCTCACACTGTAATGCCACTTAGTG - 16860
       - T  S  *  M  L  V  I  T  L  C  *  H  L  T  L  *  C  H  L  V
       - Q  V  E  C  W  *  L  L  C  V  D  I  S  H  C  N  A  T  *  C
       -  K  L  N  V  G  D  Y  F  V  L  T  S  H  T  V  M  P  L  S  A
16861 - CACCTACTCTAGTGCCACAAGAGCACTATGTGAGAATTACTGGCTTGTACCCAACACTCA - 16920
       - H  L  L  *  C  H  K  S  T  M  *  E  L  L  A  C  T  Q  H  S
       - T  Y  S  S  A  T  R  A  L  C  E  N  Y  W  L  V  P  N  T  Q
       -  P  T  L  V  P  Q  E  H  Y  V  R  I  T  G  L  Y  P  T  L  N
16921 - ACATCTCAGATGAGTTTTCTAGCAATGTTGCAAATTATCAAAAGGTCGGCATGCAAAAGT - 16980
       - T  S  Q  M  S  F  L  A  M  L  Q  I  I  K  R  S  A  C  K  S
       - H  L  R  *  V  F  *  Q  C  C  K  L  S  K  G  R  H  A  K  V
       -  I  S  D  E  F  S  S  N  V  A  N  Y  Q  K  V  G  M  Q  K  Y
16981 - ACTCTACACTCCAAGGACCACCTGGTACTGGTAAGAGTCATTTTGCCATCGGACTTGCTC - 17040
       - T  L  H  S  K  D  H  L  V  L  V  R  V  I  L  P  S  D  L  L
       - L  Y  T  P  R  T  T  W  Y  W  *  E  S  F  C  H  R  T  C  S
       -  S  T  L  Q  G  P  P  G  T  G  K  S  H  F  A  I  G  L  A  L
17041 - TCTATTACCCATCTGCTCGCATAGTGTATACGGCATGCTCTCATGCAGCTGTTGATGCCC - 17100
       - S  I  T  H  L  L  A  *  C  I  R  H  A  L  M  Q  L  L  M  P
       - L  L  P  I  C  S  H  S  V  Y  G  M  L  S  C  S  C  *  C  P
       -  Y  Y  P  S  A  R  I  V  Y  T  A  C  S  H  A  A  V  D  A  L
```

FIG. 4 Cont'd

```
17101 - TATGTGAAAAGGCATTAAAATATTTGCCCATAGATAAATGTAGTAGAATCATACCTGCGC - 17160
       - Y  V  K  R  H  *  N  I  C  P  *  I  N  V  V  E  S  Y  L  R
       - M  *  K  G  I  K  I  F  A  H  R  *  M  *  *  N  H  T  C  A
       - C  E  K  A  L  K  Y  L  P  I  D  K  C  S  R  I  I  P  A  R
17161 - GTGCGCGCGTAGAGTGTTTTGATAAATTCAAAGTGAATTCAACACTAGAACAGTATGTTT - 17220
       - V  R  A  *  S  V  L  I  N  S  K  *  I  Q  H  *  N  S  M  F
       - C  A  R  R  V  F  *  *  I  Q  S  E  F  N  T  R  T  V  C  F
       - A  R  V  E  C  F  D  K  F  K  V  N  S  T  L  E  Q  Y  V  F
17221 - TCTGCACTGTAAATGCATTGCCAGAAACAACTGCTGACATTGTAGTCTTTGATGAAATCT - 17280
       - S  A  L  *  M  H  C  Q  K  Q  L  L  T  L  *  S  L  M  K  S
       - L  H  C  K  C  I  A  R  N  N  C  *  H  C  S  L  *  *  N  L
       - C  T  V  N  A  L  P  E  T  T  A  D  I  V  V  F  D  E  I  S
17281 - CTATGGCTACTAATTATGACTTGAGTGTTGTCAATGCTAGACTTCGTGCAAAACACTACG - 17340
       - L  W  L  L  I  M  T  *  V  L  S  M  L  D  F  V  Q  N  T  T
       - Y  G  Y  *  L  *  L  E  C  C  Q  C  *  T  S  C  K  T  L  R
       - M  A  T  N  Y  D  L  S  V  V  N  A  R  L  R  A  K  H  Y  V
17341 - TCTATATTGGCGATCCTGCTCAATTACCAGCCCCCGCACATTGCTGACTAAAGGCACAC - 17400
       - S  I  L  A  I  L  L  N  Y  Q  P  P  A  H  C  *  L  K  A  H
       - L  Y  W  R  S  C  S  I  T  S  P  P  H  I  A  D  *  R  H  T
       - Y  I  G  D  P  A  Q  L  P  A  P  R  T  L  L  T  K  G  T  L
17401 - TAGAACCAGAATATTTTAATTCAGTGTGCAGACTTATGAAAACAATAGGTCCAGACATGT - 17460
       - *  N  Q  N  I  L  I  Q  C  A  D  L  *  K  Q  *  V  Q  T  C
       - R  T  R  I  F  *  F  S  V  Q  T  Y  E  N  N  R  S  R  H  V
       - E  P  E  Y  F  N  S  V  C  R  L  M  K  T  I  G  P  D  M  F
17461 - TCCTTGGAACTTGTCGCCGTTGTCCTGCTGAAATTGTTGACACTGTGAGTGCTTTAGTTT - 17520
       - S  L  E  L  V  A  V  V  L  L  K  L  L  T  L  *  V  L  *  F
       - P  W  N  L  S  P  L  S  C  *  N  C  *  H  C  E  C  F  S  L
       - L  G  T  C  R  R  C  P  A  E  I  V  D  T  V  S  A  L  V  Y
17521 - ATGACAATAAGCTAAAAGCACACAAGGAGAAGTCAGCTCAATGCTTCAAAATGTTCTACA - 17580
       - M  T  I  S  *  K  H  T  R  R  S  Q  L  N  A  S  K  C  S  T
       - *  Q  *  A  K  S  T  Q  G  E  V  S  S  M  L  Q  N  V  L  Q
       - D  N  K  L  K  A  H  K  E  K  S  A  Q  C  F  K  M  F  Y  K
17581 - AAGGTGTTATTACACATGATGTTTCATCTGCAATCAACAGACCTCAAATAGGCGTTGTAA - 17640
       - K  V  L  L  H  M  M  F  H  L  Q  S  T  D  L  K  *  A  L  *
       - R  C  Y  Y  T  *  C  F  I  C  N  Q  Q  T  S  N  R  R  C  K
       - G  V  I  T  H  D  V  S  S  A  I  N  R  P  Q  I  G  V  V  R
17641 - GAGAATTTCTTACACGCAATCCTGCTTGGAGAAAAGCTGTTTTTATCTCACCTTATAATT - 17700
       - E  N  F  L  H  A  I  L  L  G  E  K  L  F  L  S  H  L  I  I
       - R  I  S  Y  T  Q  S  C  L  E  K  S  C  F  Y  L  T  L  *  F
       - E  F  L  T  R  N  P  A  W  R  K  A  V  F  I  S  P  Y  N  S
17701 - CACAGAACGCTGTAGCTTCAAAAATCTTAGGATTGCCTACGCAGACTGTTGATTCATCAC - 17760
       - H  R  T  L  *  L  Q  K  S  *  D  C  L  R  R  L  L  I  H  H
       - T  E  R  C  S  F  K  N  L  R  I  A  Y  A  D  C  *  F  I  T
       - Q  N  A  V  A  S  K  I  L  G  L  P  T  Q  T  V  D  S  S  Q
17761 - AGGGTTCTGAATATGACTATGTCATATTCACACAAACTACTGAAACAGCACACTCTTGTA - 17820
       - R  V  L  N  M  T  M  S  Y  S  H  K  L  L  K  Q  H  T  L  V
       - G  F  *  I  *  L  C  H  I  H  T  N  Y  *  N  S  T  L  L  *
       - G  S  E  Y  D  Y  V  I  F  T  Q  T  T  E  T  A  H  S  C  N
17821 - ATGTCAACCGTTTCAATGTGGCTATCACAAGGGCAAAAATTGGCATTTTGTGCATAATGT - 17880
       - M  S  T  V  S  M  W  L  S  Q  G  Q  K  L  A  F  C  A  *  C
       - C  Q  P  F  Q  C  G  Y  H  K  G  K  N  W  H  F  V  H  N  V
       - V  N  R  F  N  V  A  I  T  R  A  K  I  G  I  L  C  I  M  S
17881 - CTGATAGAGATCTTTATGACAAACTGCAATTTACAAGTCTAGAAATACCACGTCGCAATG - 17940
       - L  I  E  I  F  M  T  N  C  N  L  Q  V  *  K  Y  H  V  A  M
       - *  *  R  S  L  *  Q  T  A  I  Y  K  S  R  N  T  T  S  Q  C
       - D  R  D  L  Y  D  K  L  Q  F  T  S  L  E  I  P  R  R  N  V
17941 - TGGCTACATTACAAGCAGAAAATGTAACTGGACTTTTTAAGGACTGTAGTAAGATCATTA - 18000
       - W  L  H  Y  K  Q  K  M  *  L  D  F  L  R  T  V  V  R  S  L
       - G  Y  I  T  S  R  K  C  N  W  T  F  *  G  L  *  *  D  H  Y
       - A  T  L  Q  A  E  N  V  T  G  L  F  K  D  C  S  K  I  I  T
```

FIG. 4 Cont'd

```
18001 - CTGGTCTTCATCCTACACAGGCACCTACACACCTCAGCGTTGATATAAAGTTCAAGACTG - 18060
       - L  V  F  I  L  H  R  H  L  H  T  S  A  L  I  *  S  S  R  L
       - W  S  S  Y  T  G  T  Y  T  P  Q  R  *  Y  K  V  Q  D  *
       - G  L  H  P  T  Q  A  P  T  H  L  S  V  D  I  K  F  K  T  E
18061 - AAGGATTATGTGTTGACATACCAGGCATACCAAAGGACATGACCTACCGTAGACTCATCT - 18120
       - K  D  Y  V  L  T  Y  Q  A  Y  Q  R  T  *  P  T  V  D  S  S
       - R  I  M  C  *  H  T  R  H  T  K  G  H  D  L  P  *  T  H  L
       - G  L  C  V  D  I  P  G  I  P  K  D  M  T  Y  R  R  L  I  S
18121 - CTATGATGGGTTCAAAATGAATTACCAAGTCAATGGTTACCCTAATATGTTTATCACCC - 18180
       - L  *  W  V  S  K  *  I  T  K  S  M  V  T  L  I  C  L  S  P
       - Y  D  G  F  Q  N  E  L  P  S  Q  W  L  P  *  Y  V  Y  H  P
       - M  M  G  F  K  M  N  Y  Q  V  N  G  Y  P  N  M  F  I  T  R
18181 - GCGAAGAAGCTATTCGTCACGTTCGTGCGTGGATTGGCTTTGATGTAGAGGGCTGTCATG - 18240
       - A  K  K  L  F  V  T  F  V  R  G  L  A  L  M  *  R  A  V  M
       - R  R  S  Y  S  S  R  S  C  V  D  W  L  *  C  R  G  L  S  C
       - E  E  A  I  R  H  V  R  A  W  I  G  F  D  V  E  G  C  H  A
18241 - CAACTAGAGATGCTGTGGGTACTAACCTACCTCTCCAGCTAGGATTTTCTACAGGTGTTA - 18300
       - Q  L  E  M  L  W  V  L  T  Y  L  S  S  *  D  F  L  Q  V  L
       - N  *  R  C  C  G  Y  *  P  T  S  P  A  R  I  F  Y  R  C  *
       - T  R  D  A  V  G  T  N  L  P  L  Q  L  G  F  S  T  G  V  N
18301 - ACTTAGTAGCTGTACCGACTGGTTATGTTGACACTGAAAATAACACAGAATTCACCAGAG - 18360
       - T  *  *  L  Y  R  L  V  M  L  T  L  K  I  T  Q  N  S  P  E
       - L  S  S  C  T  D  W  L  C  *  H  *  K  *  H  R  I  H  Q  S
       - L  V  A  V  P  T  G  Y  V  D  T  E  N  N  T  E  F  T  R  V
18361 - TTAATGCAAAACCTCCACCAGGTGACCAGTTTAAACATCTTATACCACTCATGTATAAAG - 18420
       - L  M  Q  N  L  H  Q  V  T  S  L  N  I  L  Y  H  S  C  I  K
       - *  C  K  T  S  T  R  *  P  V  *  T  S  Y  T  T  H  V  *  R
       - N  A  K  P  P  P  G  D  Q  F  K  H  L  I  P  L  M  Y  K  G
18421 - GCTTGCCCTGGAATGTAGTGCGTATTAAGATAGTACAAATGCTCAGTGATACACTGAAAG - 18480
       - A  C  P  G  M  *  C  V  L  R  *  Y  K  C  S  V  I  H  *  K
       - L  A  L  E  C  S  A  Y  *  D  S  T  N  A  Q  *  Y  T  E  R
       - L  P  W  N  V  V  R  I  K  I  V  Q  M  L  S  D  T  L  K  G
18481 - GATTGTCAGACAGAGTCGTGTTCGTCCTTTGGGCGCATGGCTTTGAGCTTACATCAATGA - 18540
       - D  C  Q  T  E  S  C  S  S  F  G  R  M  A  L  S  L  H  Q  *
       - I  V  R  Q  S  R  V  R  P  L  G  A  W  L  *  A  Y  I  N  E
       - L  S  D  R  V  V  F  V  L  W  A  H  G  F  E  L  T  S  M  K
18541 - AGTACTTTGTCAAGATTGGACCTGAAAGAACGTGTTGTCTGTGTGACAAACGTGCAACTT - 18600
       - S  T  L  S  R  L  D  L  K  E  R  V  V  C  V  T  N  V  Q  L
       - V  L  C  Q  D  W  T  *  K  N  V  L  S  V  *  Q  T  C  N  L
       - Y  F  V  K  I  G  P  E  R  T  C  C  L  C  D  K  R  A  T  C
18601 - GCTTTTCTACTTCATCAGATACTTATGCCTGCTGGAATCATTCTGTGGGTTTTGACTATG - 18660
       - A  F  L  L  H  Q  I  L  M  P  A  G  I  I  L  W  V  L  T  M
       - L  F  Y  F  I  R  Y  L  C  L  L  E  S  F  C  G  F  *  L  C
       - F  S  T  S  S  D  T  Y  A  C  W  N  H  S  V  G  F  D  Y  V
18661 - TCTATAACCCATTTATGATTGATGTTCAGCAGTGGGGCTTTACGGGTAACCTTCAGAGTA - 18720
       - S  I  T  H  L  *  L  M  F  S  S  G  A  L  R  V  T  F  R  V
       - L  *  P  I  Y  D  *  C  S  A  V  G  L  Y  G  *  P  S  E  *
       - Y  N  P  F  M  I  D  V  Q  Q  W  G  F  T  G  N  L  Q  S  N
18721 - ACCATGACCAACATTGCCAGGTACATGGAAATGCACATGTGGCTAGTTGTGATGCTATCA - 18780
       - T  M  T  N  I  A  R  Y  M  E  M  H  M  W  L  V  V  M  L  S
       - P  *  P  T  L  P  G  T  W  K  C  T  C  G  *  L  *  C  Y  H
       - H  D  Q  H  C  Q  V  H  G  N  A  H  V  A  S  C  D  A  I  M
18781 - TGACTAGATGTTAGCAGTCCATGAGTGCTTTGTTAAGCGCGTTGATTGGTCTGTTGAAT - 18840
       - *  L  D  V  *  Q  S  M  S  A  L  L  S  A  L  I  G  L  L  N
       - D  *  M  F  S  S  P  *  V  L  C  *  A  R  *  L  V  C  *  I
       - T  R  C  L  A  V  H  E  C  F  V  K  R  V  D  W  S  V  E  Y
18841 - ACCCTATTATAGGAGATGAACTGAGGGTTAATTCTGCTTGCAGAAAAGTACAACACATGG - 18900
       - T  L  L  *  E  M  N  *  G  L  I  L  L  A  E  K  Y  N  T  W
       - P  Y  Y  R  R  *  T  E  G  *  F  C  L  Q  K  S  T  T  H  G
       - P  I  I  G  D  E  L  R  V  N  S  A  C  R  K  V  Q  H  M  V
```

FIG. 4 Cont'd

```
18901 - TTGTGAAGTCTGCATTGCTTGCTGATAAGTTTCCAGTTCTTCATGACATTGGAAATCCAA - 18960
      - L * S L H C L L I S F Q F F M T L E I Q
      - C E V C I A C * * V S S S * H W K S K
      - V K S A L L A D K F P V L H D I G N P K
18961 - AGGCTATCAAGTGTGTGCCTCAGGCTGAAGTAGAATGGAAGTTCTACGATGCTCAGCCAT - 19020
      - R L S S V C L R L K * N G S S T M L S H
      - G Y Q V C A S G * S R M E V L R C S A M
      - A I K C V P Q A E V E W K F Y D A Q P C
19021 - GTAGTGACAAAGCTTACAAAATAGAGGAGCTCTTCTATTCTTATGCTACACATCACGATA - 19080
      - V V T K L T K * R S S S I L M L H I T I
      - * * Q S L Q N R G A L L F L C Y T S R *
      - S D K A Y K I E E L F Y S Y A T H H D K
19081 - AATTCACTGATGGTGTTTGTTTGTTTGGAATTGTAACGTTGATCGTTACCCAGCCAATG - 19140
      - N S L M V F V C F G I V T L I V T Q P M
      - I H * W C L F V L E L * R * S L P S Q C
      - F T D G V C L F W N C N V D R Y P A N A
19141 - CAATTGTGTGTAGGTTTGACACAAGAGTCTTGTCAAACTTGAACTTACCAGGCTGTGATG - 19200
      - Q L C V G L T Q E S C Q T * T Y Q A V M
      - N C V * V * H K S L V K L E L T R L * W
      - I V C R F D T R V L S N L N L P G C D G
19201 - GTGGTAGTTTGTATGTGAATAAGCATGCATTCCACACTCCAGCTTTCGATAAAAGTGCAT - 19260
      - V V V C M * I S M H S T L Q L S I K V H
      - W * F V C E * A C I P H S S F R * K C I
      - G S L Y V N K H A F H T P A F D K S A F
19261 - TTACTAATTTAAAGCAATTGCCTTTCTTTTACTATTCTGATAGTCCTTGTGAGTCTCATG - 19320
      - L L I * S N C L S F T I L I V L V S L M
      - Y * F K A I A F L L L F * * S L * V S W
      - T N L K Q L P F F Y Y S D S P C E S H G
19321 - GCAAACAAGTAGTGTCGGATATTGATTATGTTCCACTCAAATCTGCTACGTGTATTACAC - 19380
      - A N K * C R I L I M F H S N L L R V L H
      - Q T S S V G Y * L C S T Q I C Y V Y T
      - K Q V V S D I D Y V P L K S A T C I T R
19381 - GATGCAATTTAGGTGGTGCTGTTTGCAGACACCATGCAAATGAGTACCGACAGTACTTGG - 19440
      - D A I * V V L F A D T M Q M S T D S T W
      - M Q F R W C C L Q T P C K * V P T V L G
      - C N L G G A V C R H H A N E Y R Q Y L D
19441 - ATGCATATAATATGATGATTTCTGCTGGATTTAGCCTATGGATTTACAAACAATTTGATA - 19500
      - M H I I * * F L L D L A Y G F T N N L I
      - C I * Y D D F C W I * P M D L Q T I * Y
      - A Y N M M I S A G F S L W I Y K Q F D T
19501 - CTTATAACCTGTGGAATACATTTACCAGGTTACAGAGTTTAGAAAATGTGGCTTATAATG - 19560
      - L I T C G I H L P G Y R V * K M W L I M
      - L * P V E Y I Y Q V T E F R K C G L * C
      - Y N L W N T F T R L Q S L E N V A Y N V
19561 - TTGTTAATAAAGGACACTTTGATGGACACGCCGGCGAAGCACCTGTTTCCATCATTAATA - 19620
      - L L I K D T L M D T P A K H L F P S L I
      - C * * R T L * W T R R S T C F H H * *
      - V N K G H F D G H A G E A P V S I I N N
19621 - ATGCTGTTTACACAAAGGTAGATGGTATTGATGTGGAGATCTTTGAAAATAAGACAACAC - 19680
      - M L F T Q R * M V L M W R S L K I R Q H
      - C C L H K G R W Y * C G D L * K * D N T
      - A V Y T K V D G I D V E I F E N K T T L
19681 - TTCCTGTTAATGTTGCATTTGAGCTTTGGGCTAAGCGTAACATTAAACCAGTGCCAGAGA - 19740
      - F L L M L H L S F G L S V T L N Q C Q R
      - S C * C C I * A L G * A * H * T S A R D
      - P V N V A F E L W A K R N I K P V P E I
19741 - TTAAGATACTCAATAATTTGGGTGTTGATATCGCTGCTAATACTGTAATCTGGGACTACA - 19800
      - L R Y S I I W V L I S L L I L * S G T T
      - * D T Q * F G C * Y R C * Y C N L G L Q
      - K I L N N L G V D I A A N T V I W D Y K
```

FIG. 4 Cont'd

```
19801 - AAAGAGAAGCCCCAGCACATGTATCTACAATAGGTGTCTGCACAATGACTGACATTGCCA - 19860
      - K E K P Q H M Y L Q * V S A Q * L T L P
      - K R S P S T C I Y N R C L H N D * H C Q
      - R E A P A H V S T I G V C T M T D I A K
19861 - AGAAACCTACTGAGAGTGCTTGTTCTTCACTTACTGTCTTGTTTGATGGTAGAGTGGAAG - 19920
      - R N L L R V L V L H L L S C L M V E W K
      - E T Y * E C L F F T Y C L V * W * S G R
      - K P T E S A C S S L T V L F D G R V E G
19921 - GACAGGTAGACCTTTTTAGAAACGCCCGTAATGGTGTTTTAATAACAGAAGGTTCAGTCA - 19980
      - D R * T F L E T P V M V F * * Q K V Q S
      - T G R P F * K R P * W C F N N R R F S Q
      - Q V D L F R N A R N G V L I T E G S V K
19981 - AAGGTCTAACACCTTCAAAGGGACCAGCACAAGCTAGCGTCAATGGAGTCACATTAATTG - 20040
      - K V * H L Q R D Q H K L A S M E S H * L
      - R S N T F K G T S T S * R Q W S H I N W
      - G L T P S K G P A Q A S V N G V T L I G
20041 - GAGAATCAGTAAAAACACAGTTTAACTACTTTAAGAAAGTAGACGGCATTATTCAACAGT - 20100
      - E N Q * K H S L T T L R K * T A L F N S
      - R I S K N T V * L L * E S R R H Y S T V
      - E S V K T Q F N Y F K K V D G I I Q Q L
20101 - TGCCTGAAACCTACTTTACTCAGAGCAGAGACTTAGAGGATTTTAAGCCCAGATCACAAA - 20160
      - C L K P T L L R A E T * R I L S P D H K
      - A * N L L Y S E Q R L R G F * A Q I T N
      - P E T Y F T Q S R D L E D F K P R S Q M
20161 - TGGAAACTGACTTTCTCGAGCTCGCTATGGATGAATTCATACAGCGATATAAGCTCGAGG - 20220
      - W K L T F S S S L W M N S Y S D I S S R
      - G N * L S R A R Y G * I H T A I * A R G
      - E T D F L E L A M D E F I Q R Y K L E G
20221 - GCTATGCCTTCGAACACATCGTTTATGGAGATTTCAGTCATGGACAACTTGGCGGTCTTC - 20280
      - A M P S N T S F M E I S V M D N L A V F
      - L C L R T H R L W R F Q S W T T W R S S
      - Y A F E H I V Y G D F S H G Q L G G L H
20281 - ATTTAATGATAGGCTTAGCCAAGCGCTCACAAGATTCACCACTTAAATTAGAGGATTTTA - 20340
      - I * * * A * P S A H K I H H L N * R I L
      - F N D R L S Q A L T R F T T * I R G F Y
      - L M I G L A K R S Q D S P L K L E D F I
20341 - TCCCTATGGACAGCACAGTGAAAAATTACTTCATAACAGATGCGCAAACAGGTTCATCAA - 20400
      - S L W T A Q * K I T S * Q M R K Q V H Q
      - P Y G Q H S E K L L H N R C A N R F I K
      - P M D S T V K N Y F I T D A Q T G S S K
20401 - AATGTGTGTGTTCTGTGATTGATCTTTTACTTGATGACTTTGTCGAGATAATAAAGTCAC - 20460
      - N V C V L * L I F Y L M T L S R * * S H
      - M C V F C D * S F T * * L C R D N K V T
      - C V C S V I D L L L D D F V E I I K S Q
20461 - AAGATTTGTCAGTGATTTCAAAAGTGGTCAAGGTTACAATTGACTATGCTGAAATTTCAT - 20520
      - K I C Q * F Q K W S R L Q L T M L K F H
      - R F V S D F K S G Q G Y N * L C * N F I
      - D L S V I S K V V K V T I D Y A E I S F
20521 - TCATGCTTTGGTGTAAGGATGGACATGTTGAAACCTTCTACCCAAAACTACAAGCAAGTC - 20580
      - S C F G V R M D M L K P S T Q N Y K Q V
      - H A L V * G W T C * N L L P K T T S K S
      - M L W C K D G H V E T F Y P K L Q A S Q
20581 - AAGCGTGGCAACCAGGTGTTGCGATGCCTAACTTGTACAAGATGCAAAGAATGCTTCTTG - 20640
      - K R G N Q V L R C L T C T R C K E C F L
      - S V A T R C C D A * L V Q D A K N A S *
      - A W Q P G V A M P N L Y K M Q R M L L E
20641 - AAAAGTGTGACCTTCAGAATTATGGTGAAAATGCTGTTATACCAAAAGGAATAATGATGA - 20700
      - K S V T F R I M V K M L L Y Q K E * * *
      - K V * P S E L W * K C C Y T K R N N D E
      - K C D L Q N Y G E N A V I P K G I M M N
```

FIG. 4 Cont'd

```
20701 - ATGTCGCAAAGTATACTCAACTGTGTCAATACTTAAATACACTTACTTTAGCTGTACCCT - 20760
      - M  S  Q  S  I  L  N  C  V  N  T  *  I  H  L  L  *  L  Y  P
      -  C  R  K  V  Y  S  T  V  S  I  L  K  Y  T  Y  F  S  C  T  L
      -   V  A  K  Y  T  Q  L  C  Q  Y  L  N  T  L  T  L  A  V  P  Y
20761 - ACAACATGAGAGTTATTCACTTTGGTGCTGGCTCTGATAAAGGAGTTGCACCAGGTACAG - 20820
      - T  T  *  E  L  F  T  L  V  L  A  L  I  K  E  L  H  Q  V  Q
      -  Q  H  E  S  Y  S  L  W  C  W  L  *  *  R  S  C  T  R  Y  S
      -   N  M  R  V  I  H  F  G  A  G  S  D  K  G  V  A  P  G  T  A
20821 - CTGTGCTCAGACAATGGTTGCCAACTGGCACACTACTTGTCGATTCAGATCTTAATGACT - 20880
      - L  C  S  D  N  G  C  Q  L  A  H  Y  L  S  I  Q  I  L  M  T
      -  C  A  Q  T  M  V  A  N  W  H  T  T  C  R  F  R  S  *  *  L
      -   V  L  R  Q  W  L  P  T  G  T  L  L  V  D  S  D  L  N  D  F
20881 - TCGTCTCCGACGCAGATTCTACTTTAATTGGAGACTGTGCAACAGTACATACGGCTAATA - 20940
      - S  S  P  T  Q  I  L  L  *  L  E  T  V  Q  Q  Y  I  R  L  I
      -  R  L  R  R  R  F  Y  F  N  W  R  L  C  N  S  T  Y  G  *  *
      -   V  S  D  A  D  S  T  L  I  G  D  C  A  T  V  H  T  A  N  K
20941 - AATGGGACCTTATTATTAGCGATATGTATGACCCTAGGACCAAACATGTGACAAAAGAGA - 21000
      - N  G  T  L  L  L  A  I  C  M  T  L  G  P  N  M  *  Q  K  R
      -  M  G  P  Y  Y  *  R  Y  V  *  P  *  D  Q  T  C  D  K  R  E
      -   W  D  L  I  I  S  D  M  Y  D  P  R  T  K  H  V  T  K  E  N
21001 - ATGACTCTAAAGAAGGGTTTTTTCACTTATCTGTGTGGATTTATAAAGCAAAAACTAGCCC - 21060
      - M  T  L  K  K  G  F  S  L  I  C  V  D  L  *  S  K  N  *  P
      -  *  L  *  R  R  V  F  H  L  S  V  W  I  Y  K  A  K  T  S  P
      -   D  S  K  E  G  F  F  T  Y  L  C  G  F  I  K  Q  K  L  A  L
21061 - TGGGTGGTTCTATAGCTGTAAAGATAACAGAGCATTCTTGGAATGCTGACCTTTACAAGC - 21120
      - W  V  V  L  *  L  *  R  *  Q  S  I  L  G  M  L  T  F  T  S
      -  G  W  F  Y  S  C  K  D  N  R  A  F  L  E  C  *  P  L  Q  A
      -   G  G  S  I  A  V  K  I  T  E  H  S  W  N  A  D  L  Y  K  L
21121 - TTATGGGCCATTTCTCATGGTGGACAGCTTTTGTTACAAATGTAAATGCATCATCATCGG - 21180
      - L  W  A  I  S  H  G  G  Q  L  L  L  Q  M  *  M  H  H  H  R
      -  Y  G  P  F  L  M  V  D  S  F  C  Y  K  C  K  C  I  I  I  G
      -   M  G  H  F  S  W  W  T  A  F  V  T  N  V  N  A  S  S  S  E
21181 - AAGCATTTTTAATTGGGGCTAACTATCTTGGCAAGCCGAAGGAACAAATTGATGGCTATA - 21240
      - K  H  F  *  L  G  L  T  I  L  A  S  R  R  N  K  L  M  A  I
      -  S  I  F  N  W  G  *  L  S  W  Q  A  E  G  T  N  *  W  L  Y
      -   A  F  L  I  G  A  N  Y  L  G  K  P  K  E  Q  I  D  G  Y  T
21241 - CCATGCATGCTAACTACATTTTCTGGAGGAACACAAATCCTATCCAGTTGTCTTCCTATT - 21300
      - P  C  M  L  T  T  F  S  G  G  T  Q  I  L  S  S  C  L  P  I
      -  H  A  C  *  L  H  F  L  E  E  H  K  S  Y  P  V  V  L  L  F
      -   M  H  A  N  Y  I  F  W  R  N  T  N  P  I  Q  L  S  S  Y  S
21301 - CACTCTTTGACATGAGCAAATTTCCTCTTAAATTAAGAGGAACTGCTGTAATGTCTCTTA - 21360
      - H  S  L  T  *  A  N  F  L  L  N  *  E  E  L  L  *  C  L  L
      -  T  L  *  H  E  Q  I  S  S  *  I  K  R  N  C  C  N  V  S  *
      -   L  F  D  M  S  K  F  P  L  K  L  R  G  T  A  V  M  S  L  K
21361 - AGGAGAATCAAATCAATGATATGATTTATTCTCTTCTGGAAAAAGGTAGGCTTATCATTA - 21420
      - R  R  I  K  S  M  I  *  F  I  L  F  W  K  K  V  G  L  S  L
      -  G  E  S  N  Q  *  Y  D  L  F  S  S  G  K  R  *  A  Y  H  *
      -   E  N  Q  I  N  D  M  I  Y  S  L  L  E  K  G  R  L  I  I  R
21421 - GAGAAAACAACAGAGTTGTGGTTTCAAGTGATATTCTTGTTAACAACTAAACGAACATGT - 21480
      - E  K  T  T  E  L  W  F  Q  V  I  F  L  L  T  T  K  R  T  C
      -  R  K  Q  Q  S  C  G  F  K  *  Y  S  C  *  Q  L  N  E  H  V
      -   E  N  N  R  V  V  V  S  S  D  I  L  V  N  N  *  T  N  M  F
21481 - TTATTTCTTATTATTTCTTACTCTCACTAGTGGTAGTGACCTTGACCGGTGCACCACTT - 21540
      - L  F  S  Y  Y  F  L  L  S  L  V  V  V  T  L  T  G  A  P  L
      -  Y  F  L  I  I  S  Y  S  H  *  W  *  *  P  *  P  V  H  H  F
      -   I  F  L  L  F  L  T  L  T  S  G  S  D  L  D  R  C  T  T  F
21541 - TTGATGATGTTCAAGCTCCTAATTACACTCAACATACTTCATCTATGAGGGGGGTTTACT - 21600
      - L  M  M  F  K  L  L  I  T  L  N  I  L  H  L  *  G  G  F  T
      -  *  *  C  S  S  S  *  L  H  S  T  Y  F  I  Y  E  G  G  L  L
      -   D  D  V  Q  A  P  N  Y  T  Q  H  T  S  S  M  R  G  V  Y  Y
```

FIG. 4 Cont'd

```
21601 - ATCCTGATGAAATTTTTAGATCAGACACTCTTTATTTAACTCAGGATTTATTTCTTCCAT - 21660
       - I  L  M  K  F  L  D  Q  T  L  F  I  *  L  R  I  Y  F  F  H
       - S  *  *  N  F  *  I  R  H  S  L  F  N  S  G  F  I  S  S  I
       - P  D  E  I  F  R  S  D  T  L  Y  L  T  Q  D  L  F  L  P  F
21661 - TTTATTCTAATGTTACAGGGTTTCATACTATTAATCATACGTTTGACAACCCTGTCATAC - 21720
       - F  I  L  M  L  Q  G  F  I  L  L  I  I  R  L  T  T  L  S  Y
       - L  F  *  C  Y  R  V  S  Y  Y  *  S  Y  V  *  Q  P  C  H  T
       - Y  S  N  V  T  G  F  H  T  I  N  H  T  F  D  N  P  V  I  P
21721 - CTTTTAAGGATGGTATTTATTTTGCTGCCACAGAGAAATCAAATGTTGTCCGTGGTTGGG - 21780
       - L  L  R  M  V  F  I  L  L  P  Q  R  N  Q  M  L  S  V  V  G
       - F  *  G  W  Y  L  F  C  C  H  R  E  I  K  C  C  P  W  L  G
       - F  K  D  G  I  Y  F  A  A  T  E  K  S  N  V  V  R  G  W  V
21781 - TTTTTGGTTCTACCATGAACAACAAGTCACAGTCGGTGATTATTATTAACAATTCTACTA - 21840
       - F  L  V  L  P  *  T  T  S  H  S  R  *  L  L  L  T  I  L  L
       - F  W  F  Y  H  E  Q  Q  V  T  V  G  D  Y  Y  *  Q  F  Y  *
       - F  G  S  T  M  N  N  K  S  Q  S  V  I  I  I  N  N  S  T  N
21841 - ATGTTGTTATACGAGCATGTAACTTTGAATTGTGTGACAACCCTTTCTTTGCTGTTTCTA - 21900
       - M  L  L  Y  E  H  V  T  L  N  C  V  T  T  L  S  L  L  F  L
       - C  C  Y  T  S  M  *  L  *  I  V  *  Q  P  F  L  C  C  F  *
       - V  V  I  R  A  C  N  F  E  L  C  D  N  P  F  F  A  V  S  K
21901 - AACCCATGGGTACACAGACACATACTATGATATTCGATAATGCATTTAATTGCACTTTCG - 21960
       - N  P  W  V  H  R  H  I  L  *  Y  S  I  M  H  L  I  A  L  S
       - T  H  G  Y  T  D  T  Y  Y  D  I  R  *  C  I  *  L  H  F  R
       - P  M  G  T  Q  T  H  T  M  I  F  D  N  A  F  N  C  T  F  E
21961 - AGTACATATCTGATGCCTTTTCGCTTGATGTTTCAGAAAAGTCAGGTAATTTTAAACACT - 22020
       - S  T  Y  L  M  P  F  R  L  M  F  Q  K  S  Q  V  I  L  N  T
       - V  H  I  *  C  L  F  A  *  C  F  R  K  V  R  *  F  *  T  L
       - Y  I  S  D  A  F  S  L  D  V  S  E  K  S  G  N  F  K  H  L
22021 - TACGAGAGTTTGTGTTTAAAAATAAAGATGGGTTTCTCTATGTTTATAAGGGCTATCAAC - 22080
       - Y  E  S  L  C  L  K  I  K  M  G  F  S  M  F  I  R  A  I  N
       - T  R  V  C  V  *  K  *  R  W  V  S  L  C  L  *  G  L  S  T
       - R  E  F  V  F  K  N  K  D  G  F  L  Y  V  Y  K  G  Y  Q  P
22081 - CTATAGATGTAGTTCGTGATCTACCTTCTGGTTTTAACACTTTGAAACCTATTTTTAAGT - 22140
       - L  *  M  *  F  V  I  Y  L  L  V  L  T  L  *  N  L  F  L  S
       - Y  R  C  S  S  *  S  T  F  W  F  *  H  F  E  T  Y  F  *  V
       - I  D  V  V  R  D  L  P  S  G  F  N  T  L  K  P  I  F  K  L
22141 - TGCCTCTTGGTATTAACATTACAAATTTTAGAGCCATTCTTACAGCCTTTTCACCTGCTC - 22200
       - C  L  L  V  L  T  L  Q  I  L  E  P  F  L  Q  P  F  H  L  L
       - A  S  W  Y  *  H  Y  K  F  *  S  H  S  Y  S  L  F  T  C  S
       - P  L  G  I  N  I  T  N  F  R  A  I  L  T  A  F  S  P  A  Q
22201 - AAGACACTTGGGGCACGTCAGCTGCAGCCTATTTTGTTGGCTATTTAAAGCCAACTACAT - 22260
       - K  T  L  G  A  R  Q  L  Q  P  I  L  L  A  I  *  S  Q  L  H
       - R  H  L  G  H  V  S  C  S  L  F  C  W  L  F  K  A  N  Y  I
       - D  T  W  G  T  S  A  A  A  Y  F  V  G  Y  L  K  P  T  T  F
22261 - TTATGCTCAAGTATGATGAAAATGGTACAATCACAGATGCTGTTGATTGTTCTCAAAATC - 22320
       - L  C  S  S  M  M  K  M  V  Q  S  Q  M  L  L  I  V  L  K  I
       - Y  A  Q  V  *  *  K  W  Y  N  H  R  C  C  *  L  F  S  K  S
       - M  L  K  Y  D  E  N  G  T  I  T  D  A  V  D  C  S  Q  N  P
22321 - CACTTGCTGAACTCAAATGCTCTGTTAAGAGCTTTGAGATTGACAAAGGAATTTACCAGA - 22380
       - H  L  L  N  S  N  A  L  L  R  A  L  R  L  T  K  E  F  T  R
       - T  C  *  T  Q  M  L  C  *  E  L  *  D  *  Q  R  N  L  P  D
       - L  A  E  L  K  C  S  V  K  S  F  E  I  D  K  G  I  Y  Q  T
22381 - CCTCTAATTTCAGGGTTGTTCCCTCAGGAGATGTTGTGAGATTCCCTAATATTACAAACT - 22440
       - P  L  I  S  G  L  F  P  Q  E  M  L  *  D  S  L  I  L  Q  T
       - L  *  F  Q  G  C  S  L  R  R  C  C  E  I  P  *  Y  Y  K  L
       - S  N  F  R  V  V  P  S  G  D  V  V  R  F  P  N  I  T  N  L
22441 - TGTGTCCTTTTGGAGAGGTTTTTAATGCTACTAAATTCCCTTCTGTCTATGCATGGGAGA - 22500
       - C  V  L  L  E  R  F  L  M  L  L  N  S  L  L  S  M  H  G  R
       - V  S  F  W  R  G  F  *  C  Y  *  I  P  F  C  L  C  M  G  E
       - C  P  F  G  E  V  F  N  A  T  K  F  P  S  V  Y  A  W  E  R
```

FIG. 4 Cont'd

```
22501 - GAAAAAAAATTTCTAATTGTGTTGCTGATTACTCTGTGCTCTACAACTCAACATTTTTTT - 22560
      - E  K  K  F  L  I  V  L  L  I  T  L  C  S  T  T  Q  H  F  F
      - K  K  N  F  *  L  C  C  *  L  L  C  A  L  Q  L  N  I  F  F
      - K  K  I  S  N  C  V  A  D  Y  S  V  L  Y  N  S  T  F  F  S
22561 - CAACCTTTAAGTGCTATGGCGTTTCTGCCACTAAGTTGAATGATCTTTGCTTCTCCAATG - 22620
      - Q  P  L  S  A  M  A  F  L  P  L  S  *  M  I  F  A  S  P  M
      - N  L  *  V  L  W  R  F  C  H  *  V  E  *  S  L  L  L  Q  C
      - T  F  K  C  Y  G  V  S  A  T  K  L  N  D  L  C  F  S  N  V
22621 - TCTATGCAGATTCTTTTGTAGTCAAGGGAGATGATGTAAGACAAATAGCGCCAGGACAAA - 22680
      - S  M  Q  I  L  L  *  S  R  E  M  M  *  D  K  *  R  Q  D  K
      - L  C  R  F  F  C  S  Q  G  R  *  C  K  T  N  S  A  R  T  N
      - Y  A  D  S  F  V  V  K  G  D  D  V  R  Q  I  A  P  G  Q  T
22681 - CTGGTGTTATTGCTGATTATAATTATAAATTGCCAGATGATTTCATGGGTTGTGTCCTTG - 22740
      - L  V  L  L  L  I  I  I  *  L  P  D  D  F  M  G  C  V  L
      - W  C  Y  C  *  L  *  L  *  I  A  R  *  F  H  G  L  C  P  C
      - G  V  I  A  D  Y  N  Y  K  L  P  D  D  F  M  G  C  V  L  A
22741 - CTTGGAATACTAGGAACATTGATGCTACTTCAACTGGTAATTATAATTATAAATATAGGT - 22800
      - L  G  I  L  G  T  L  M  L  L  Q  L  V  I  I  I  N  I  G
      - L  E  Y  *  E  H  *  C  Y  F  N  W  *  L  *  L  *  I  *  V
      - W  N  T  R  N  I  D  A  T  S  T  G  N  Y  N  Y  K  Y  R  Y
22801 - ATCTTAGACATGGCAAGCTTAGGCCCTTTGAGAGAGACATATCTAATGTGCCTTTCTCCC - 22860
      - I  L  D  M  A  S  L  G  P  L  R  E  T  Y  L  M  C  L  S  P
      - S  *  T  W  Q  A  *  A  L  *  E  R  H  I  *  C  A  F  L  P
      - L  R  H  G  K  L  R  P  F  E  R  D  I  S  N  V  P  F  S  P
22861 - CTGATGGCAAACCTTGCACCCCACCTGCTCTTAATTGTTATTGGCCATTAAATGATTATG - 22920
      - L  M  A  N  L  A  P  H  L  L  L  I  V  I  G  H  *  M  I  M
      - *  W  Q  T  L  H  P  T  C  S  *  L  L  L  A  I  K  *  L  W
      - D  G  K  P  C  T  P  P  A  L  N  C  Y  W  P  L  N  D  Y  G
22921 - GTTTTTACACCACTACTGGCATTGGCTACCAACCTTACAGAGTTGTAGTACTTTCTTTTG - 22980
      - V  F  T  P  L  L  A  L  A  T  N  L  T  E  L  *  Y  F  L  L
      - F  L  H  H  Y  W  H  W  L  P  T  L  Q  S  C  S  T  F  F  *
      - F  Y  T  T  T  G  I  G  Y  Q  P  Y  R  V  V  V  L  S  F  E
22981 - AACTTTTAAATGCACCGGCCACGGTTTGTGGACCAAAATTATCCACTGACCTTATTAAGA - 23040
      - N  F  *  M  H  R  P  R  F  V  D  Q  N  Y  P  L  T  L  L  R
      - T  F  K  C  T  G  H  G  L  W  T  K  I  I  H  *  P  Y  *  E
      - L  L  N  A  P  A  T  V  C  G  P  K  L  S  T  D  L  I  K  N
23041 - ACCAGTGTGTCAATTTTAATTTTAATGGACTCACTGGTACTGGTGTGTTAACTCCTTCTT - 23100
      - T  S  V  S  I  L  I  L  M  D  S  L  V  L  V  C  *  L  L  L
      - P  V  C  Q  F  *  F  *  W  T  H  W  Y  W  C  V  N  S  F  F
      - Q  C  V  N  F  N  F  N  G  L  T  G  T  G  V  L  T  P  S  S
23101 - CAAAGAGATTTCAACCATTTCAACAATTTGGCCGTGATGTTTCTGATTTCACTGATTCCG - 23160
      - Q  R  D  F  N  H  F  N  N  L  A  V  M  F  L  I  S  L  I  P
      - K  E  I  S  T  I  S  T  I  W  P  *  C  F  *  F  H  *  F  R
      - K  R  F  Q  P  F  Q  Q  F  G  R  D  V  S  D  F  T  D  S  V
23161 - TTCGAGATCCTAAAACATCTGAAATATTAGACATTTCACCTTGCTCTTTTGGGGGTGTAA - 23220
      - F  E  I  L  K  H  L  K  Y  *  T  F  H  L  A  L  L  G  V  *
      - S  R  S  *  N  I  *  N  I  R  H  F  T  L  L  F  W  G  C  K
      - R  D  P  K  T  S  E  I  L  D  I  S  P  C  S  F  G  G  V  S
23221 - GTGTAATTACACCTGGAACAAATGCTTCATCTGAAGTTGCTGTTCTATATCAAGATGTTA - 23280
      - V  *  L  H  L  E  Q  M  L  H  L  K  L  L  F  Y  I  K  M  L
      - C  N  Y  T  W  N  K  C  F  I  *  S  C  C  S  I  S  R  C  *
      - V  I  T  P  G  T  N  A  S  S  E  V  A  V  L  Y  Q  D  V  N
23281 - ACTGCACTGATGTTTCTACAGCAATTCATGCAGATCAACTCACACCAGCTTGGCGCATAT - 23340
      - T  A  L  M  F  L  Q  Q  F  M  Q  I  N  S  H  Q  L  G  A  Y
      - L  H  *  C  F  Y  S  N  S  C  R  S  T  H  T  S  L  A  H  I
      - C  T  D  V  S  T  A  I  H  A  D  Q  L  T  P  A  W  R  I  Y
23341 - ATTCTACTGGAAACAATGTATTCCAGACTCAAGCAGGCTGTCTTATAGGAGCTGAGCATG - 23400
      - I  L  L  E  T  M  Y  S  R  L  K  Q  A  V  L  *  E  L  S  M
      - F  Y  W  K  Q  C  I  P  D  S  S  R  L  S  Y  R  S  *  A  C
      - S  T  G  N  N  V  F  Q  T  Q  A  G  C  L  I  G  A  E  H  V
```

FIG. 4 Cont'd

```
23401 - TCGACACTTCTTATGAGTGCGACATTCCTATTGGAGCTGGCATTTGTGCTAGTTACCATA - 23460
       - S  T  L  L  M  S  A  T  F  L  L  E  L  A  F  V  L  V  T  I
       - R  H  F  L  *  V  R  H  S  Y  W  S  W  H  L  C  *  L  P  Y
       -  D  T  S  Y  E  C  D  I  P  I  G  A  G  I  C  A  S  Y  H  T
23461 - CAGTTTCTTTATTACGTAGTACTAGCCAAAAATCTATTGTGGCTTATACTATGTCTTTAG - 23520
       - Q  F  L  Y  Y  V  V  L  A  K  N  L  L  W  L  I  L  C  L  *
       -  S  F  F  I  T  *  Y  *  P  K  I  Y  C  G  L  Y  Y  V  F  R
       -   V  S  L  L  R  S  T  S  Q  K  S  I  V  A  Y  T  M  S  L  G
23521 - GTGCTGATAGTTCAATTGCTTACTCTAATAACACCATTGCTATACCTACTAACTTTTCAA - 23580
       - V  L  I  V  Q  L  L  T  L  I  T  P  L  L  Y  L  L  T  F  Q
       -  C  *  *  F  N  C  L  L  *  *  H  H  C  Y  T  Y  *  L  F  N
       -   A  D  S  S  I  A  Y  S  N  N  T  I  A  I  P  T  N  F  S  I
23581 - TTAGCATTACTACAGAAGTAATGCCTGTTTCTATGGCTAAAACCTCCGTAGATTGTAATA - 23640
       - L  A  L  L  Q  K  *  C  L  F  L  W  L  K  P  P  *  I  V  I
       -  *  H  Y  Y  R  S  N  A  C  F  Y  G  *  N  L  R  R  L  *  Y
       -   S  I  T  T  E  V  M  P  V  S  M  A  K  T  S  V  D  C  N  M
23641 - TGTACATCTGCGGAGATTCTACTGAATGTGCTAATTTGCTTCTCCAATATGGTAGCTTTT - 23700
       - C  T  S  A  E  I  L  L  N  V  L  I  C  F  S  N  M  V  A  F
       -  V  H  L  R  R  F  Y  *  M  C  *  F  A  S  P  I  W  *  L  L
       -   Y  I  C  G  D  S  T  E  C  A  N  L  L  L  Q  Y  G  S  F  C
23701 - GCACACAACTAAATCGTGCACTCTCAGGTATTGCTGCTGAACAGGATCGCAACACACGTG - 23760
       - A  H  N  *  I  V  H  S  Q  V  L  L  L  N  R  I  A  T  H  V
       -  H  T  T  K  S  C  T  L  R  Y  C  C  *  T  G  S  Q  H  T  *
       -   T  Q  L  N  R  A  L  S  G  I  A  A  E  Q  D  R  N  T  R  E
23761 - AAGTGTTCGCTCAAGTCAAACAAATGTACAAAACCCCAACTTTGAAATATTTTGGTGGTT - 23820
       - K  C  S  L  K  S  N  K  C  T  K  P  Q  L  *  N  I  L  V  V
       -  S  V  R  S  S  Q  T  N  V  Q  N  P  N  F  E  I  F  W  W  F
       -   V  F  A  Q  V  K  Q  M  Y  K  T  P  T  L  K  Y  F  G  G  F
23821 - TTAATTTTTCACAAATATTACCTGACCCTCTAAAGCCAACTAAGAGGTCTTTTATTGAGG - 23880
       - L  I  F  H  K  Y  Y  L  T  L  *  S  Q  L  R  G  L  L  R
       -  *  F  F  T  N  I  T  *  P  S  K  A  N  *  E  V  F  Y  *  G
       -   N  F  S  Q  I  L  P  D  P  L  K  P  T  K  R  S  F  I  E  D
23881 - ACTTGCTCTTTAATAAGGTGACACTCGCTGATGCTGGCTTCATGAAGCAATATGGCGAAT - 23940
       - T  C  S  L  I  R  *  H  S  L  M  L  A  S  *  S  N  M  A  N
       -  L  A  L  *  *  G  D  T  R  *  C  W  L  H  E  A  I  W  R  M
       -   L  L  F  N  K  V  T  L  A  D  A  G  F  M  K  Q  Y  G  E  C
23941 - GCCTAGGTGATATTAATGCTAGAGATCTCATTTGTGCGCAGAAGTTCAATGGACTTACAG - 24000
       - A  *  V  I  L  M  L  E  I  S  F  V  R  R  S  S  M  D  L  Q
       -  P  R  *  Y  *  C  *  R  S  H  L  C  A  E  V  Q  W  T  Y  S
       -   L  G  D  I  N  A  R  D  L  I  C  A  Q  K  F  N  G  L  T  V
24001 - TGTTGCCACCTCTGCTCACTGATGATATGATTGCTGCCTACACTGCTGCTCTAGTTAGTG - 24060
       - C  C  H  L  C  S  L  M  I  *  L  L  P  T  L  L  L  *  L  V
       -  V  A  T  S  A  H  *  *  Y  D  C  C  L  H  C  C  S  S  *  W
       -   L  P  P  L  L  T  D  D  M  I  A  A  Y  T  A  A  L  V  S  G
24061 - GTACTGCCACTGCTGGATGGACATTTGGTGCTGGCGCTGCTCTTCAAATACCTTTTGCTA - 24120
       - V  L  P  L  L  D  G  H  L  V  L  A  L  L  F  K  Y  L  L  L
       -  Y  C  H  C  W  M  D  I  W  C  W  R  C  S  S  N  T  F  C  Y
       -   T  A  T  A  G  W  T  F  G  A  G  A  A  L  Q  I  P  F  A  M
24121 - TGCAAATGGCATATAGGTTCAATGGCATTGGAGTTACCCAAAATGTTCTCTATGAGAACC - 24180
       - C  K  W  H  I  G  S  M  A  L  E  L  P  K  M  F  S  M  R  T
       -  A  N  G  I  *  V  Q  W  H  W  S  Y  P  K  C  S  L  *  E  P
       -   Q  M  A  Y  R  F  N  G  I  G  V  T  Q  N  V  L  Y  E  N  Q
24181 - AAAAACAAATCGCCAACCAATTTAACAAGGCGATTAGTCAAATTCAAGAATCACTTACAA - 24240
       - K  N  K  S  P  T  N  L  T  R  R  L  V  K  F  K  N  H  L  Q
       -  K  T  N  R  Q  P  I  *  Q  G  D  *  S  N  S  R  I  T  Y  N
       -   K  Q  I  A  N  Q  F  N  K  A  I  S  Q  I  Q  E  S  L  T  T
24241 - CAACATCAACTGCATTGGGCAAGCTGCAAGACGTTGTTAACCAGAATGCTCAAGCATTAA - 24300
       - Q  H  Q  L  H  W  A  S  C  K  T  L  L  T  R  M  L  K  H  *
       -  N  I  N  C  I  G  Q  A  A  R  R  C  *  P  E  C  S  S  I  K
       -   T  S  T  A  L  G  K  L  Q  D  V  V  N  Q  N  A  Q  A  L  N
```

FIG. 4 Cont'd

```
24301 - ACACACTTGTTAAACAACTTAGCTCTAATTTTGGTGCAATTTCAAGTGTGCTAAATGATA - 24360
       - T  H  L  L  N  N  L  A  L  I  L  V  Q  F  Q  V  C  *  M  I
       - H  T  C  *  T  T  *  L  *  F  W  C  N  F  K  C  A  K  *  Y
       -   T  L  V  K  Q  L  S  S  N  F  G  A  I  S  S  V  L  N  D  I
24361 - TCCTTTCGCGACTTGATAAAGTCGAGGCGGAGGTACAAATTGACAGGTTAATTACAGGCA - 24420
       - S  F  R  D  L  I  K  S  R  R  R  Y  K  L  T  G  *  L  Q  A
       - P  F  A  T  *  *  S  R  G  G  G  T  N  *  Q  V  N  Y  R  Q
       -   L  S  R  L  D  K  V  E  A  E  V  Q  I  D  R  L  I  T  G  R
24421 - GACTTCAAAGCCTTCAAACCTATGTAACACAACAACTAATCAGGGCTGCTGAAATCAGGG - 24480
       - D  F  K  A  F  K  P  M  *  H  N  N  *  S  G  L  L  K  S  G
       - T  S  K  P  S  N  L  C  N  T  T  T  N  Q  G  C  *  N  Q  G
       -   L  Q  S  L  Q  T  Y  V  T  Q  Q  L  I  R  A  A  E  I  R  A
24481 - CTTCTGCTAATCTTGCTGCTACTAAAATGTCTGAGTGTGTTCTTGGACAATCAAAAAGAG - 24540
       - L  L  L  I  L  L  L  L  K  C  L  S  V  F  L  D  N  Q  K  E
       - F  C  *  S  C  C  Y  *  N  V  *  V  C  S  W  T  I  K  K  S
       -   S  A  N  L  A  A  T  K  M  S  E  C  V  L  G  Q  S  K  R  V
24541 - TTGACTTTTGTGGAAAGGGCTACCACCTTATGTCCTTCCCACAAGCAGCCCCGCATGGTG - 24600
       - L  T  F  V  E  R  A  T  T  L  C  P  S  H  K  Q  P  R  M  V
       - *  L  L  W  K  G  L  P  P  Y  V  L  P  T  S  S  P  A  W  C
       -   D  F  C  G  K  G  Y  H  L  M  S  F  P  Q  A  A  P  H  G  V
24601 - TTGTCTTCCTACATGTCACGTATGTGCCATCCCAGGAGAGGAACTTCACCACAGCGCCAG - 24660
       - L  S  S  Y  M  S  R  M  C  H  P  R  R  G  T  S  P  Q  R  Q
       - C  L  P  T  C  H  V  C  A  I  P  G  E  E  L  H  H  S  A  S
       -   V  F  L  H  V  T  Y  V  P  S  Q  E  R  N  F  T  T  A  P  A
24661 - CAATTTGTCATGAAGGCAAAGCATACTTCCCTCGTGAAGGTGTTTTTGTGTTTAATGGCA - 24720
       - Q  F  V  M  K  A  K  H  T  S  L  V  K  V  F  L  C  L  M  A
       - N  L  S  *  R  Q  S  I  L  P  S  *  R  C  F  C  V  *  W  H
       -   I  C  H  E  G  K  A  Y  F  P  R  E  G  V  F  V  F  N  G  T
24721 - CTTCTTGGTTTATTACACAGAGGAACTTCTTTTCTCCACAAATAATTACTACAGACAATA - 24780
       - L  L  G  L  L  H  R  G  T  S  F  L  H  K  *  L  L  Q  T  I
       - F  L  V  Y  Y  T  E  E  L  L  F  S  T  N  N  Y  Y  R  Q  Y
       -   S  W  F  I  T  Q  R  N  F  F  S  P  Q  I  I  T  T  D  N  T
24781 - CATTTGTCTCAGGAAATTGTGATGTCGTTATTGGCATCATTAACAACACAGTTTATGATC - 24840
       - H  L  S  Q  E  I  V  M  S  L  L  A  S  L  T  T  Q  F  M  I
       - I  C  L  R  K  L  *  C  R  Y  W  H  H  *  Q  H  S  L  *  S
       -   F  V  S  G  N  C  D  V  V  I  G  I  I  N  N  T  V  Y  D  P
24841 - CTCTGCAACCTGAGCTTGACTCATTCAAAGAAGAGCTGGACAAGTACTTCAAAAATCATA - 24900
       - L  C  N  L  S  L  T  H  S  K  K  S  W  T  S  T  S  K  I  I
       - S  A  T  *  A  *  L  I  Q  R  R  A  G  Q  V  L  Q  K  S  Y
       -   L  Q  P  E  L  D  S  F  K  E  E  L  D  K  Y  F  K  N  H  T
24901 - CATCACCAGATGTTGATCTTGGCGACATTTCAGGCATTAACGCTTCTGTCGTCAACATTC - 24960
       - H  H  Q  M  L  I  L  A  T  F  Q  A  L  T  L  L  S  S  T  F
       - I  T  R  C  *  S  W  R  H  F  R  H  *  R  F  C  R  Q  H  S
       -   S  P  D  V  D  L  G  D  I  S  G  I  N  A  S  V  V  N  I  Q
24961 - AAAAAGAAATTGACCGCCTCAATGAGGTCGCTAAAAATTTAAATGAATCACTCATTGACC - 25020
       - K  K  K  L  T  A  S  M  R  S  L  K  I  *  M  N  H  S  L  T
       - K  R  N  *  P  P  Q  *  G  R  *  K  F  K  *  I  T  H  *  P
       -   K  E  I  D  R  L  N  E  V  A  K  N  L  N  E  S  L  I  D  L
25021 - TTCAAGAATTGGGAAAATATGAGCAATATATTAAATGGCCTTGGTATGTTTGGCTCGGCT - 25080
       - F  K  N  W  E  N  M  S  N  I  L  N  G  L  G  M  F  G  S  A
       - S  R  I  G  K  I  *  A  I  Y  *  M  A  L  V  C  L  A  R  L
       -   Q  E  L  G  K  Y  E  Q  Y  I  K  W  P  W  Y  V  W  L  G  F
25081 - TCATTGCTGGACTAATTGCCATCGTCATGGTTACAATCTTGCTTTGTTGCATGACTAGTT - 25140
       - S  L  L  D  *  L  P  S  S  W  L  Q  S  C  F  V  A  *  L  V
       - H  C  W  T  N  C  H  R  H  G  Y  N  L  A  L  L  H  D  *  L
       -   I  A  G  L  I  A  I  V  M  V  T  I  L  L  C  C  M  T  S  C
25141 - GTTGCAGTTGCCTCAAGGGTGCATGCTCTTGTGGTTCTTGCTGCAAGTTTGATGAGGATG - 25200
       - V  A  V  A  S  R  V  H  A  L  V  V  L  A  A  S  L  M  R  M
       - L  Q  L  P  Q  G  C  M  L  L  W  F  L  L  Q  V  *  *  G  *
       -   C  S  C  L  K  G  A  C  S  C  G  S  C  C  K  F  D  E  D  D
```

FIG. 4 Cont'd

```
25201 - ACTCTGAGCCAGTTCTCAAGGGTGTCAAATTACATTACACATAAACGAACTTATGGATTT - 25260
      -   T  L  S  Q  F  S  R  V  S  N  Y  I  T  H  K  R  T  Y  G  F
      - L  *  A  S  S  Q  G  C  Q  I  T  L  H  I  N  E  L  M  D  L
      -    S  E  P  V  L  K  G  V  K  L  H  Y  T  *  T  N  L  W  I  C
25261 - GTTTATGAGATTTTTTACTCTTGGATCAATTACTGCACAGCCAGTAAAAATTGACAATGC - 25320
      -   V  Y  E  I  F  Y  S  W  I  N  Y  C  T  A  S  K  N  *  Q  C
      - F  M  R  F  F  T  L  G  S  I  T  A  Q  P  V  K  I  D  N  A
      -    L  *  D  F  L  L  L  D  Q  L  L  H  S  Q  *  K  L  T  M  L
25321 - TTCTCCTGCAAGTACTGTTCATGCTACAGCAACGATACCGCTACAAGCCTCACTCCCTTT - 25380
      -   F  S  C  K  Y  C  S  C  Y  S  N  D  T  A  T  S  L  T  P  F
      - S  P  A  S  T  V  H  A  T  A  T  I  P  L  Q  A  S  L  P  F
      -    L  L  Q  V  L  F  M  L  Q  Q  R  Y  R  Y  K  P  H  S  L  S
25381 - CGGATGGCTTGTTATTGGCGTTGCATTTCTTGCTGTTTTCAGAGCGCTACCAAAATAAT - 25440
      -   R  M  A  C  Y  W  R  C  I  S  C  C  F  S  E  R  Y  Q  N  N
      - G  W  L  V  I  G  V  A  F  L  A  V  F  Q  S  A  T  K  I  I
      -    D  G  L  L  L  A  L  H  F  L  L  F  F  R  A  L  P  K  *  L
25441 - TGCGCTCAATAAAAGATGGCAGCTAGCCCTTTATAAGGGCTTCCAGTTCATTTGCAATTT - 25500
      -   C  A  Q  *  K  M  A  A  S  P  L  *  G  L  P  V  H  L  Q  F
      - A  L  N  K  R  W  Q  L  A  L  Y  K  G  F  Q  F  I  C  N  L
      -    R  S  I  K  D  G  S  *  P  F  I  R  A  S  S  S  F  A  I  Y
25501 - ACTGCTGCTATTTGTTACCATCTATTCACATCTTTTGCTTGTCGCTGCAGGTATGGAGGC - 25560
      -   T  A  A  I  C  Y  H  L  F  T  S  F  A  C  R  C  R  Y  G  G
      - L  L  L  F  V  T  I  Y  S  H  L  L  L  V  A  A  G  M  E  A
      -    C  C  Y  L  L  P  S  I  H  I  F  C  L  S  L  Q  V  W  R  R
25561 - GCAATTTTTGTACCTCTATGCCTTGATATATTTTCTACAATGCATCAACGCATGTAGAAT - 25620
      -   A  I  F  V  P  L  C  L  D  I  F  S  T  M  H  Q  R  M  *  N
      - Q  F  L  Y  L  Y  A  L  I  Y  F  L  Q  C  I  N  A  C  R  I
      -    N  F  C  T  S  M  P  *  Y  I  F  Y  N  A  S  T  H  V  E  L
25621 - TATTATGAGATGTTGGCTTTGTTGGAAGTGCAAATCCAAGAACCCATTACTTTATGATGC - 25680
      -   Y  Y  E  M  L  A  L  L  E  V  Q  I  Q  E  P  I  T  L  *  C
      - I  M  R  C  W  L  C  W  K  C  K  S  K  N  P  L  L  Y  D  A
      -    L  *  D  V  G  F  V  G  S  A  N  P  R  T  H  Y  F  M  M  P
25681 - CAACTACTTTGTTTGCTGGCACACACATAACTATGACTACTGTATACCATATAACAGTGT - 25740
      -   Q  L  L  C  L  L  A  H  T  *  L  *  L  L  Y  T  I  *  Q  C
      - N  Y  F  V  C  W  H  T  H  N  Y  D  Y  C  I  P  Y  N  S  V
      -    T  T  L  F  A  G  T  H  I  T  M  T  T  V  Y  H  I  T  V  S
25741 - CACAGATACAATTGTCGTTACTGAAGGTGACGGCATTTCAACACCAAAACTCAAAGAAGA - 25800
      -   H  R  Y  N  C  R  Y  *  R  *  R  H  F  N  T  K  T  Q  R  R
      - T  D  T  I  V  V  T  E  G  D  G  I  S  T  P  K  L  K  E  D
      -    Q  I  Q  L  S  L  L  K  V  T  A  F  Q  H  Q  N  S  K  K  T
25801 - CTACCAAATTGGTGGTTATTCTGAGGATAGGCACTCAGGTGTTAAAGACTATGTCGTTGT - 25860
      -   L  P  N  W  W  L  F  *  G  *  A  L  R  C  *  R  L  C  R  C
      - Y  Q  I  G  G  Y  S  E  D  R  H  S  G  V  K  D  Y  V  V  V
      -    T  K  L  V  V  I  L  R  I  G  T  Q  V  L  K  T  M  S  L  Y
25861 - ACATGGCTATTTCACCGAAGTTTACTACCAGCTTGAGTCTACACAAATTACTACAGACAC - 25920
      -   T  W  L  F  H  R  S  L  L  P  A  *  V  Y  T  N  Y  Y  R  H
      - H  G  Y  F  T  E  V  Y  Y  Q  L  E  S  T  Q  I  T  T  D  T
      -    M  A  I  S  P  K  F  T  T  S  L  S  L  H  K  L  L  Q  T  L
25921 - TGGTATTGAAAATGCTACATTCTTCATCTTTAACAAGCTTGTTAAAGACCCACCGAATGT - 25980
      -   W  Y  *  K  C  Y  I  L  H  L  *  Q  A  C  *  R  P  T  E  C
      - G  I  E  N  A  T  F  F  I  F  N  K  L  V  K  D  P  P  N  V
      -    V  L  K  M  L  H  S  S  S  L  T  S  L  L  K  T  H  R  M  C
25981 - GCAAATACACACAATCGACGGCTCTTCAGGAGTTGCTAATCCAGCAATGGATCCAATTTA - 26040
      -   A  N  T  H  N  R  R  L  F  R  S  C  *  S  S  N  G  S  N  L
      - Q  I  H  T  I  D  G  S  S  G  V  A  N  P  A  M  D  P  I  Y
      -    K  Y  T  Q  S  T  A  L  Q  E  L  L  I  Q  Q  W  I  Q  F  M
26041 - TGATGAGCCGACGACGACTACTAGCGTGCCTTTGTAAGCACAAGAAAGTGAGTACGAACT - 26100
      -   *  *  A  D  D  D  Y  *  R  A  F  V  S  T  R  K  *  V  R  T
      - D  E  P  T  T  T  T  S  V  P  L  *  A  Q  E  S  E  Y  E  L
      -    M  S  R  R  R  L  L  A  C  L  C  K  H  K  K  V  S  T  N  L
```

FIG. 4 Cont'd

```
26101 - TATGTACTCATTCGTTTCGGAAGAAACAGGTACGTTAATAGTTAATAGCGTACTTCTTTT - 26160
       - Y V L I R F G R N R Y V N S * * R T S F
       - M Y S F V S E E T G T L I V N S V L L F
       -   C T H S F R K K Q V R * * L I A Y F F F
26161 - TCTTGCTTTCGTGGTATTCTTGCTAGTCACACTAGCCATCCTTACTGCGCTTCGATTGTG - 26220
       - S C F R G I L A S H T S H P Y C A S I V
       - L A F V V F L L V T L A I L T A L R L C
       -   L L S W Y S C * S H * P S L L R F D C V
26221 - TGCGTACTGCTGCAATATTGTTAACGTGAGTTTAGTAAAACCAACGGTTTACGTCTACTC - 26280
       - C V L L Q Y C * R E F S K T N G L R L L
       - A Y C C N I V N V S L V K P T V Y V Y S
       -   R T A A I L L T * V * * N Q R F T S T R
26281 - GCGTGTTAAAAATCTGAACTCTTCTGAAGGAGTTCCTGATCTTCTGGTCTAAACGAACTA - 26340
       - A C * K S E L F * R S S * S S G L N E L
       - R V K N L N S S E G V P D L L V * T N *
       -   V L K I * T L L K E F L I F W S K R T N
26341 - ACTATTATTATTATTCTGTTTGGAACTTTAACATTGCTTATCATGGCAGACAACGGTACT - 26400
       - T I I I L F G T L T L L I M A D N G T
       - L L L L F C L E L * H C L S W Q T T V L
       -   Y Y Y Y S V W N F N I A Y H G R Q R Y Y
26401 - ATTACCGTTGAGGAGCTTAAACAACTCCTGGAACAATGGAACCTAGTAATAGGTTTCCTA - 26460
       - I T V E E L K Q L L E Q W N L V I G F L
       - L P L R S L N N S W N N G T * * * V S Y
       -   Y R * G A * T T P G T M E P S N R F P I
26461 - TTCCTAGCCTGGATTATGTTACTACAATTTGCCTATTCTAATCGGAACAGGTTTTTGTAC - 26520
       - F L A W I M L L Q F A Y S N R N R F L Y
       - S * P G L C Y Y N L P I L I G T G F C T
       -   P S L D Y V T T I C L F * S E Q V F V H
26521 - ATAATAAAGCTTGTTTTCCTCTGGCTCTTGTGGCCAGTAACACTTGCTTGTTTTGTGCTT - 26580
       - I I K L V F L W L L W P V T L A C F V L
       - * * S L F S S G S C G Q * H L L V L C L
       -   N K A C F P L A L V A S N T C L F C A C
26581 - GCTGCTGTCTACAGAATTAATTGGGTGACTGGCGGGATTGCGATTGCAATGGCTTGTATT - 26640
       - A A V Y R I N W V T G G I A I A M A C I
       - L L S T E L I G * L A G L R L Q W L V L
       -   C C L Q N * L G D W R D C D C N G L Y C
26641 - GTAGGCTTGATGTGGCTTAGCTACTTCGTTGCTTCCTTCAGGCTGTTTGCTCGTACCCGC - 26700
       - V G L M W L S Y F V A S F R L F A R T R
       - * A * C G L A T S L L P S G C L L V P A
       -   R L D V A * L L R C F L Q A V C S Y P L
26701 - TCAATGTGGTCATTCAACCCAGAAACAAACATTCTTCTCAATGTGCCTCTCCGGGGGACA - 26760
       - S M W S F N P E T N I L L N V P L R G T
       - Q C G H S T Q K Q T F F S M C L S G G Q
       -   N V V I Q P R N K H S S Q C A S P G D N
26761 - ATTGTGACCAGACCGCTCATGGAAAGTGAACTTGTCATTGGTGCTGTGATCATTCGTGGT - 26820
       - I V T R P L M E S E L V I G A V I I R G
       - L * P D R S W K V N L S L V L * S F V V
       -   C D Q T A H G K * T C H W C C D H S W S
26821 - CACTTGCGAATGGCCGGACACTCCCTAGGGCGCTGTGACATTAAGGACCTGCCAAAAGAG - 26880
       - H L R M A G H S L G R C D I K D L P K E
       - T C E W P D T P * G A V T L R T C Q K R
       -   L A N G R T L P R A L * H * G P A K R D
26881 - ATCACTGTGGCTACATCACGAACGCTTTCTTATTACAAATTAGGAGCGTCGCAGCGTGTA - 26940
       - I T V A T S R T L S Y Y K L G A S Q R V
       - S L W L H H E R F L I T N * E R R S V *
       -   H C G Y I T N A F L L Q I R S V A A C R
26941 - GGCACTGATTCAGGTTTTGCTGCATACAACCGCTACCGTATTGGAAACTATAAATTAAAT - 27000
       - G T D S G F A A Y N R Y R I G N Y K L N
       - A L I Q V L L H T T A T V L E T I N * I
       -   H * F R F C C I Q P L P Y W K L * I K Y
```

FIG. 4 Cont'd

```
27001 - ACAGACCACGCCGGTAGCAACGACAATATTGCTTTGCTAGTACAGTAAGTGACAACAGAT - 27060
       -  T  D  H  A  G  S  N  D  N  I  A  L  L  V  Q  *  V  T  T  D
       -  Q  T  T  P  V  A  T  T  I  L  L  C  *  Y  S  K  *  Q  Q  M
       -  R  P  R  R  *  Q  R  Q  Y  C  F  A  S  T  V  S  D  N  R  C
27061 - GTTTCATCTTGTTGACTTCCAGGTTACAATAGCAGAGATATTGATTATCATTATGAGGAC - 27120
       -  V  S  S  C  *  L  P  G  Y  N  S  R  D  I  D  Y  H  Y  E  D
       -  F  H  L  V  D  F  Q  V  T  I  A  E  I  L  I  I  I  M  R  T
       -  F  I  L  L  T  S  R  L  Q  *  Q  R  Y  *  L  S  L  *  G  L
27121 - TTTCAGGATTGCTATTTGGAATCTTGACGTTATAATAAGTTCAATAGTGAGACAATTATT - 27180
       -  F  Q  D  C  Y  L  E  S  *  R  Y  N  K  F  N  S  E  T  I  I
       -  F  R  I  A  I  W  N  L  D  V  I  I  S  S  I  V  R  Q  L  F
       -  S  G  L  L  F  G  I  L  T  L  *  *  V  Q  *  *  D  N  Y  L
27181 - TAAGCCTCTAACTAAGAAGAATTATTCGGAGTTAGATGATGAAGAACCTATGGAGTTAGA - 27240
       -  *  A  S  N  *  E  E  L  F  G  V  R  *  *  R  T  Y  G  V  R
       -  K  P  L  T  K  K  N  Y  S  E  L  D  D  E  E  P  M  E  L  D
       -  S  L  *  L  R  R  I  I  R  S  *  M  M  K  N  L  W  S  *  I
27241 - TTATCCATAAAACGAACATGAAAATTATTCTCTTCCTGACATTGATTGTATTTACATCTT - 27300
       -  L  S  I  K  R  T  *  K  L  F  S  S  *  H  *  L  Y  L  H  L
       -  Y  P  *  N  E  H  E  N  Y  S  L  P  D  I  D  C  I  Y  I  L
       -  I  H  K  T  N  M  K  I  I  L  F  L  T  L  I  V  F  T  S  C
27301 - GCGAGCTATATCACTATCAGGAGTGTGTTAGAGGTACGACTGTACTACTAAAAGAACCTT - 27360
       -  A  S  Y  I  T  I  R  S  V  L  E  V  R  L  Y  Y  *  K  N  L
       -  R  A  I  S  L  S  G  V  C  *  R  Y  D  C  T  T  K  R  T  L
       -  E  L  Y  H  Y  Q  E  C  V  R  G  T  T  V  L  L  K  E  P  C
27361 - GCCCATCAGGAACATACGAGGGCAATTCACCATTTCACCCTCTTGCTGACAATAAATTTG - 27420
       -  A  H  Q  E  H  T  R  A  I  H  H  F  T  L  L  T  I  N  L
       -  P  I  R  N  I  R  G  Q  F  T  I  S  P  S  C  *  Q  *  I  C
       -  P  S  G  T  Y  E  G  N  S  P  F  H  P  L  A  D  N  K  F  A
27421 - CACTAACTTGCACTAGCACACACTTTGCTTTTGCTTGTGCTGACGGTACTCGACATACCT - 27480
       -  H  *  L  A  L  A  H  T  L  L  L  V  L  T  V  L  D  I  P
       -  T  N  L  H  *  H  T  L  C  F  C  L  C  *  R  Y  S  T  Y  L
       -  L  T  C  T  S  T  H  F  A  F  A  C  A  D  G  T  R  H  T  Y
27481 - ATCAGCTGCGTGCAAGATCAGTTTCACCAAAACTTTTCATCAGACAAGAGGAGGTTCAAC - 27540
       -  I  S  C  V  Q  D  Q  F  H  Q  N  F  S  S  D  K  R  R  F  N
       -  S  A  A  C  K  I  S  F  T  K  T  F  H  Q  T  R  G  G  S  T
       -  Q  L  R  A  R  S  V  S  P  K  L  F  I  R  Q  E  E  V  Q  Q
27541 - AAGAGCTCTACTCGCCACTTTTTCTCATTGTTGCTGCTCTAGTATTTTTAATACTTTGCT - 27600
       -  K  S  S  T  R  H  F  F  S  L  L  L  L  *  Y  F  *  Y  F  A
       -  R  A  L  L  A  T  F  S  H  C  C  C  S  S  I  F  N  T  L  L
       -  E  L  Y  S  P  L  F  L  I  V  A  A  L  V  F  L  I  L  C  F
27601 - TCACCATTAAGAGAAAGACAGAATGAATGAGCTCACTTTAATTGACTTCTATTTGTGCTT - 27660
       -  S  P  L  R  E  R  Q  N  E  *  A  H  F  N  *  L  L  F  V  L
       -  H  H  *  E  K  D  R  M  N  E  L  T  L  I  D  F  Y  L  C  F
       -  T  I  K  R  K  T  E  *  M  S  S  L  *  L  T  S  I  C  A  F
27661 - TTTAGCCTTTCTGCTATTCCTTGTTTTAATAATGCTTATTATATTTTGGTTTTCACTCGA - 27720
       -  F  S  L  S  A  I  P  C  F  N  N  A  Y  Y  I  L  V  F  T  R
       -  L  A  F  L  L  P  L  V  L  I  M  L  I  I  F  W  F  S  L  E
       -  *  P  F  C  Y  S  L  F  *  *  C  L  L  Y  F  G  F  H  S  K
27721 - AATCCAGGATCTAGAAGAACCTTGTACCAAAGTCTAAACGAACATGAAACTTCTCATTGT - 27780
       -  N  P  G  S  R  R  T  L  Y  Q  S  L  N  E  H  E  T  S  H  C
       -  I  Q  D  L  E  E  P  C  T  K  V  *  T  N  M  K  L  L  I  V
       -  S  R  I  *  K  N  L  V  P  K  S  K  R  T  *  N  F  S  L  F
27781 - TTTGACTTGTATTTCTCTATGCAGTTGCATACGCACTGTAGTACAGCGCTGTGCATCTAA - 27840
       -  F  D  L  Y  F  S  M  Q  L  H  T  H  C  S  T  A  L  C  I  *
       -  L  T  C  I  S  L  C  S  C  I  R  T  V  V  Q  R  C  A  S  N
       -  *  L  V  F  L  Y  A  V  A  Y  A  L  *  Y  S  A  V  H  L  I
27841 - TAAACCTCATGTGCTTGAAGATCCTTGTAAGGTACAACACTAGGGGTAATACTTATAGCA - 27900
       -  *  T  S  C  A  *  R  S  L  *  G  T  T  L  G  V  I  L  I  A
       -  K  P  H  V  L  E  D  P  C  K  V  Q  H  *  G  *  Y  L  *  H
       -  N  L  M  C  L  K  I  L  V  R  Y  N  T  R  G  N  T  Y  S  T
```

FIG. 4 Cont'd

```
27901 - CTGCTTGGCTTTGTGCTCTAGGAAAGGTTTTACCTTTTCATAGATGGCACACTATGGTTC - 27960
      - L  L  G  F  V  L  *  E  R  F  Y  L  F  I  D  G  T  L  W  F
      -  C  L  A  L  C  S  R  K  G  F  T  F  S  *  M  A  H  Y  G  S
      -   A  W  L  C  A  L  G  K  V  L  P  F  H  R  W  H  T  M  V  Q
27961 - AAACATGCACACCTAATGTTACTATCAACTGTCAAGATCCAGCTGGTGGTGCGCTTATAG - 28020
      - K  H  A  H  L  M  L  L  S  T  V  K  I  Q  L  V  V  R  L  *
      -  N  M  H  T  *  C  Y  Y  Q  L  S  R  S  S  W  W  C  A  Y  S
      -   T  C  T  P  N  V  T  I  N  C  Q  D  P  A  G  G  A  L  I  A
28021 - CTAGGTGTTGGTACCTTCATGAAGGTCACCAAACTGCTGCATTTAGAGACGTACTTGTTG - 28080
      - L  G  V  G  T  F  M  K  V  T  K  L  L  H  L  E  T  Y  L  L
      -  *  V  L  V  P  S  *  R  S  P  N  C  C  I  *  R  R  T  C  C
      -   R  C  W  Y  L  H  E  G  H  Q  T  A  A  F  R  D  V  L  V  V
28081 - TTTTAAATAAACGAACAAATTAAAATGTCTGATAATGGACCCCAATCAAACCAACGTAGT - 28140
      - F  *  I  N  E  Q  I  K  M  S  D  N  G  P  Q  S  N  Q  R  S
      -  F  K  *  T  N  K  L  K  C  L  I  M  D  P  N  Q  T  N  V  V
      -   L  N  K  R  T  N  *  N  V  *  *  W  T  P  I  K  P  T  *  C
28141 - GCCCCCCGCATTACATTTGGTGGACCCACAGATTCAACTGACAATAACCAGAATGGAGGA - 28200
      - A  P  R  I  T  F  G  G  P  T  D  S  T  D  N  N  Q  N  G  G
      -  P  P  A  L  H  L  V  D  P  Q  I  Q  L  T  I  T  R  M  E  D
      -   P  P  H  Y  I  W  W  T  H  R  F  N  *  Q  *  P  E  W  R  T
28201 - CGCAATGGGGCAAGGCCAAAACAGCGCCGACCCCAAGGTTTACCCAATAATACTGCGTCT - 28260
      - R  N  G  A  R  P  K  Q  R  R  P  Q  G  L  P  N  N  T  A  S
      -  A  M  G  Q  G  Q  N  S  A  D  P  K  V  Y  P  I  I  L  R  L
      -   Q  W  G  K  A  K  T  A  P  T  P  R  F  T  Q  *  Y  C  V  L
28261 - TGGTTCACAGCTCTCACTCAGCATGGCAAGGAGGAACTTAGATTCCCTCGAGGCCAGGGC - 28320
      - W  F  T  A  L  T  Q  H  G  K  E  E  L  R  F  P  R  G  Q  G
      -  G  S  Q  L  S  L  S  M  A  R  R  N  L  D  S  L  E  A  R  A
      -   V  H  S  S  H  S  A  W  Q  G  G  T  *  I  P  S  R  P  G  R
28321 - GTTCCAATCAACACCAATAGTGGTCCAGATGACCAAATTGGCTACTACCGAAGAGCTACC - 28380
      - V  P  I  N  T  N  S  G  P  D  D  Q  I  G  Y  Y  R  R  A  T
      -  F  Q  S  T  P  I  V  V  Q  M  T  K  L  A  T  T  E  E  L  P
      -   S  N  Q  H  Q  *  W  S  R  *  P  N  W  L  L  P  K  S  Y  P
28381 - CGACGAGTTCGTGGTGGTGACGGCAAAATGAAAGAGCTCAGCCCCAGATGGTACTTCTAT - 28440
      - R  R  V  R  G  G  D  G  K  M  K  E  L  S  P  R  W  Y  F  Y
      -  D  E  F  V  V  V  T  A  K  *  K  S  S  A  P  D  G  T  S  I
      -   T  S  S  W  W  *  R  Q  N  E  R  A  Q  P  Q  M  V  L  L  L
28441 - TACCTAGGAACTGGCCCAGAAGCTTCACTTCCCTACGGCGCTAACAAAGAAGGCATCGTA - 28500
      - Y  L  G  T  G  P  E  A  S  L  P  Y  G  A  N  K  E  G  I  V
      -  T  *  E  L  A  Q  K  L  H  F  P  T  A  L  T  K  K  A  S  Y
      -   P  R  N  W  P  R  S  F  T  S  L  R  R  *  Q  R  R  H  R  M
28501 - TGGGTTGCAACTGAGGGAGCCTTGAATACACCCAAAGACCACATTGGCACCCGCAATCCT - 28560
      - W  V  A  T  E  G  A  L  N  T  P  K  D  H  I  G  T  R  N  P
      -  G  L  Q  L  R  E  P  *  I  H  P  K  T  T  L  A  P  A  I  L
      -   G  C  N  *  G  S  L  E  Y  T  Q  R  P  H  W  H  P  Q  S  *
28561 - AATAACAATGCTGCCACCGTGCTACAACTTCCTCAAGGAACAACATTGCCAAAAGGCTTC - 28620
      - N  N  N  A  A  T  V  L  Q  L  P  Q  G  T  T  L  P  K  G  F
      -  I  T  M  L  P  P  C  Y  N  F  L  K  E  Q  H  C  Q  K  A  S
      -   *  Q  C  C  H  R  A  T  T  S  S  R  N  N  I  A  K  R  L  L
28621 - TACGCAGAGGGAAGCAGAGGCGGCAGTCAAGCCTCTTCTCGCTCCTCATCACGTAGTCGC - 28680
      - Y  A  E  G  S  R  G  G  S  Q  A  S  S  R  S  S  S  R  S  R
      -  T  Q  R  E  A  E  A  A  V  K  P  L  L  A  P  H  H  V  V  A
      -   R  R  G  K  Q  R  R  Q  S  S  L  F  S  L  L  I  T  *  S  R
28681 - GGTAATTCAAGAAATTCAACTCCTGGCAGCAGTAGGGGAAATTCTCCTGCTCGAATGGCT - 28740
      - G  N  S  R  N  S  T  P  G  S  S  R  G  N  S  P  A  R  M  A
      -  V  I  Q  E  I  Q  L  L  A  A  V  G  E  I  L  L  L  E  W  L
      -   *  F  K  K  F  N  S  W  Q  Q  *  G  K  F  S  C  S  N  G  *
28741 - AGCGGAGGTGGTGAAACTGCCCTCGCGCTATTGCTGCTAGACAGATTGAACCAGCTTGAG - 28800
      - S  G  G  G  E  T  A  L  A  L  L  L  L  D  R  L  N  Q  L  E
      -  A  E  V  V  K  L  P  S  R  Y  C  C  *  T  D  *  T  S  L  R
      -   R  R  W  *  N  C  P  R  A  I  A  A  R  Q  I  E  P  A  *  E
```

FIG. 4 Cont'd

```
28801 - AGCAAAGTTTCTGGTAAAGGCCAACAACAACAAGGCCAAACTGTCACTAAGAAATCTGCT - 28860
       - S  K  V  S  G  K  G  Q  Q  Q  Q  G  Q  T  V  T  K  K  S  A
       -  A  K  F  L  V  K  A  N  N  N  K  A  K  L  S  L  R  N  L  L
       -   Q  S  F  W  *  R  P  T  T  T  R  P  N  C  H  *  E  I  C  C
28861 - GCTGAGGCATCTAAAAAGCCTCGCCAAAAACGTACTGCCACAAAACAGTACAACGTCACT - 28920
       - A  E  A  S  K  K  P  R  Q  K  R  T  A  T  K  Q  Y  N  V  T
       -  L  R  H  L  K  S  L  A  K  N  V  L  P  Q  N  S  T  T  S  L
       -   *  G  I  *  K  A  S  P  K  T  Y  C  H  K  T  V  Q  R  H  S
28921 - CAAGCATTTGGGAGACGTGGTCCAGAACAAACCCAAGGAAATTTCGGGGACCAAGACCTA - 28980
       - Q  A  F  G  R  R  G  P  E  Q  T  Q  G  N  F  G  D  Q  D  L
       -  K  H  L  G  D  V  V  Q  N  K  P  K  E  I  S  G  T  K  T  *
       -   S  I  W  E  T  W  S  R  T  N  P  R  K  F  R  G  R  P  N
28981 - ATCAGACAAGGAACTGATTACAAACATTGGCCGCAAATTGCACAATTTGCTCCAAGTGCC - 29040
       - I  R  Q  G  T  D  Y  K  H  W  P  Q  I  A  Q  F  A  P  S  A
       -  S  D  K  E  L  I  T  N  I  G  R  K  L  H  N  L  L  Q  V  X
       -   Q  T  R  N  *  L  Q  T  L  A  A  N  C  T  I  C  S  K  C  X
29041 - TCTGCATTCTTTGGAATGTCACGCATTGGCATGGAAGTCACACCTTCGGGAACATGGCTG - 29100
       - S  A  F  F  G  M  S  R  I  G  M  E  V  T  P  S  G  T  W  L
       -  L  H  S  L  E  C  H  A  L  A  W  K  S  H  L  R  E  H  G  *
       -   C  I  L  W  N  V  T  H  W  H  G  S  H  T  F  G  N  M  A  D
29101 - ACTTATCATGGAGCCATTAAATTGGATGACAAAGATCCACAATTCAAAGACAACGTCATA - 29160
       - T  Y  H  G  A  I  K  L  D  D  K  D  P  Q  F  K  D  N  V  I
       -  L  I  M  E  P  L  N  W  M  T  K  I  H  N  S  K  T  T  S  Y
       -   L  S  W  S  H  *  I  G  *  Q  R  S  T  I  Q  R  Q  R  H  T
29161 - CTGCTGAACAAGCACATTGACGCATACAAAACATTCCCACCAACAGAGCCTAAAAAGGAC - 29220
       - L  L  N  K  H  I  D  A  Y  K  T  F  P  P  T  E  P  K  K  D
       -  C  *  T  S  T  L  T  H  T  K  H  S  H  Q  Q  S  L  K  R  T
       -   A  E  Q  A  H  *  R  I  Q  N  I  P  T  N  R  A  *  K  G  Q
29221 - AAAAAGAAAAAGACTGATGAAGCTCAGCCTTTGCCGCAGAGACAAAAGAAGCAGCCCACT - 29280
       - K  K  K  K  T  D  E  A  Q  P  L  P  Q  R  Q  K  K  Q  P  T
       -  K  R  K  R  L  M  K  L  S  L  C  R  R  D  K  R  S  S  P  L
       -   K  E  K  D  *  *  S  S  A  F  A  A  E  T  K  E  A  A  H  C
29281 - GTGACTCTTCTTCCTGCGGCTGACATGGATGATTTCTCCAGACAACTTCAAAATTCCATG - 29340
       - V  T  L  L  P  A  A  D  M  D  D  F  S  R  Q  L  Q  N  S  M
       -  *  L  F  F  L  R  L  T  W  M  I  S  P  D  N  F  K  I  P  *
       -   D  S  S  S  C  G  *  H  G  *  F  L  Q  T  T  S  K  F  H  E
29341 - AGTGGAGCTTCTGCTGATTCAACTCAGGCATAAACACTCATGATGACCACACAAGGCAGA - 29400
       - S  G  A  S  A  D  S  T  Q  A  *  T  L  M  M  T  T  Q  G  R
       -  V  E  L  L  L  I  Q  L  R  H  K  H  S  *  *  P  H  K  A  D
       -   W  S  F  C  *  F  N  S  G  I  N  T  H  D  D  H  T  R  Q  M
29401 - TGGGCTATGTAAACGTTTTCGCAATTCCGTTTACGATACATAGTCTACTCTTGTGCAGAA - 29460
       - W  A  M  *  T  F  S  Q  F  R  L  R  Y  I  V  Y  S  C  A  E
       -  G  L  C  K  R  F  R  N  S  V  Y  D  T  *  S  T  L  V  Q  N
       -   G  Y  V  N  V  F  A  I  P  F  T  I  H  S  L  L  L  C  R  M
29461 - TGAATTCTCGTAACTAAACAGCACAAGTAGGTTTAGTTAACTTTAATCTCACATAGCAAT - 29520
       - *  I  L  V  T  K  Q  H  K  *  V  *  L  T  L  I  S  H  S  N
       -  E  F  S  *  L  N  S  T  S  R  F  S  *  L  *  S  H  I  A  I
       -   N  S  R  N  *  T  A  Q  V  G  L  V  N  F  N  L  T  *  Q  S
29521 - CTTTAATCAATGTGTAACATTAGGGAGGACTTGAAAGAGCCACCACATTTTCATCGAGGC - 29580
       - L  *  S  M  C  N  I  R  E  D  L  K  E  P  P  H  F  H  R  G
       -  F  N  Q  C  V  T  L  G  R  T  *  K  S  H  H  I  F  I  E  A
       -   L  I  N  V  *  H  *  G  G  L  E  R  A  T  T  F  S  S  R  P
29581 - CACGCGGAGTACGATCGAGGGTACAGTGAATAATGCTAGGGAGAGCTGCCTATATGGAAG - 29640
       - H  A  E  Y  D  R  G  Y  S  E  *  C  *  G  E  L  P  I  W  K
       -  T  R  S  T  I  E  G  T  V  N  N  A  R  E  S  C  L  Y  G  R
       -   R  G  V  R  S  R  V  Q  *  I  M  L  G  R  A  A  Y  M  E  E
29641 - AGCCCTAATGTGTAAAATTAATTTTAGTAGTGCTATCCCCATGTGATTTTAATAGCTTCT - 29700
       - S  P  N  V  *  N  *  F  *  *  C  Y  P  H  V  I  L  I  A  S
       -  A  L  M  C  K  I  N  F  S  S  A  I  P  M  *  F  *  *  L  L
```

FIG. 4 Cont'd

```
            -     P  *  C  V  K  L  I  L  V  V  L  S  P  C  D  F  N  S  F  L
    29701   - TAGGAGAATGACAAAAAAAAAAAAAAAAAAAAAAAA - 29736
            -  *  E  N  D  K  K  K  K  K  K  K  K  X
            -  R  R  M  T  K  K  K  K  K  K  K  X
            -  G  E  *  Q  K  K  K  K  K  K  K  X
```

FIG. 4 Cont'd

```
  1 - GATGGGTCCTTTTCGGTTGGTTGGAGCTAGAGAACATCTAGACAAGAGATTTGCTTGAAA -  60
    - D  G  S  F  S  V  G  W  S  *  R  T  S  R  Q  E  I  C  L  K
    -  M  G  P  F  R  L  V  G  A  R  E  H  L  D  K  R  F  A  *  N
    -   W  V  L  F  G  W  L  E  L  E  N  I  *  T  R  D  L  L  E  I
 61 - TTTTAGACACATCGACAGCGAGCCGACGTACGGATCACGTGGATGCGTCATATTTGTTAT - 120
    - F  *  T  H  R  Q  R  A  D  V  R  I  T  W  M  R  H  I  C  Y
    -  F  R  H  I  D  S  E  P  T  Y  G  S  R  G  C  V  I  F  V  I
    -   L  D  T  S  T  A  S  R  R  T  D  H  V  D  A  S  Y  L  L  L
121 - TATTTAAAATGACAGCAACTGTTCTTTGCTCATTGAGCAGGGAGAAGACGTCTGACGAAT - 180
    - Y  L  K  *  Q  Q  L  F  F  A  H  *  A  G  R  R  R  L  T  N
    -  I  *  N  D  S  N  C  S  L  L  I  E  Q  G  E  D  V  *  R  M
    -   F  K  M  T  A  T  V  L  C  S  L  S  R  E  K  T  S  D  E  C
181 - GCCAAAGCAGGCACAACGTCAGCTAGTAGTCGTATGGATCCAAAGCAGGCCCACACTGGC - 240
    - A  K  A  G  T  T  S  A  S  S  R  M  D  P  K  Q  A  H  T  G
    -  P  K  Q  A  Q  R  Q  L  V  V  V  W  I  Q  S  R  P  T  L  A
    -   Q  S  R  H  N  V  S  *  *  S  Y  G  S  K  A  G  P  H  W  L
241 - TTTCCATTCTACCTCTCGGAACAAGAACCACAGTTGCTCTTTTGTGTGCAGGTTGAGTCA - 300
    - F  P  F  Y  L  S  E  Q  E  P  Q  L  L  F  C  V  Q  V  E  S
    -  F  H  S  T  S  R  N  K  N  H  S  C  S  F  V  C  R  L  S  Q
    -   S  I  L  P  L  G  T  R  T  T  V  A  L  L  C  A  G  *  V  K
301 - AACGGACAGGAAGTCCAATCTCTGCACGATCACGCACCGAAGCCCCTGAGACACCTTCTC - 360
    - N  G  Q  E  V  Q  S  L  H  D  H  A  P  K  P  L  R  H  L  L
    -  T  D  R  K  S  N  L  C  T  I  T  H  R  S  P  *  D  T  F  S
    -   R  T  G  S  P  I  S  A  R  S  R  T  E  A  P  E  T  P  S  P
361 - CGGGATAGCCTCCGTGCACTTGTGGAGTTTTTACCGTGAACACCAGATCATCTCGACCTT - 420
    - R  D  S  L  R  A  L  V  E  F  L  P  *  T  P  D  H  L  D  L
    -  G  I  A  S  V  H  L  W  S  F  Y  R  E  H  Q  I  I  S  T  F
    -   G  *  P  P  C  T  C  G  V  F  T  V  N  T  R  S  S  R  P  F
421 - TTTCCGCATGACGGGGTCGAACTTGTCGGGATACACAAGTAATTTGCAAGACTACGGAAT - 480
    - F  P  H  D  G  V  E  L  V  G  I  H  K  *  F  A  R  L  R  N
    -  F  R  M  T  G  S  N  L  S  G  Y  T  S  N  L  Q  D  Y  G  I
    -   S  A  *  R  G  R  T  C  R  D  T  Q  V  I  C  K  T  T  E  F
481 - TCGTGGTTAGTGCCGGTGTTCCAGCAACTCGACCAACGTCTTTACCTGCCGTAAGTCATG - 540
    - S  W  L  V  P  V  F  Q  Q  L  D  Q  R  L  Y  L  P  *  V  M
    -  R  G  *  C  R  C  S  S  N  S  T  N  V  F  T  C  R  K  S  C
    -   V  V  S  A  G  V  P  A  T  R  P  T  S  L  P  A  V  S  H  A
541 - CCAGCATCGCCATATTGTGACCCTCATGAGCACGGTGTACACCCGCTTTGGGGTTAACGT - 600
    - P  A  S  P  Y  C  D  P  H  E  H  G  V  H  P  L  W  G  *  R
    -  Q  H  R  H  I  V  T  L  M  S  T  V  Y  T  R  F  G  V  N  V
    -   S  I  A  I  L  *  P  S  *  A  R  C  T  P  A  L  G  L  T  Y
601 - ATGGCGTTACAAGAAGAAGCATTCTTGCCATTATTCCCTCGGCCACCAGTATCGATACCG - 660
    - M  A  L  Q  E  E  A  F  L  P  L  F  P  R  P  P  V  S  I  P
    -  W  R  Y  K  K  K  H  S  C  H  Y  S  L  G  H  Q  Y  R  Y  R
    -   G  V  T  R  R  S  I  L  A  I  I  P  S  A  T  S  I  D  T  V
661 - TAGCTAGATTTCAGAATACTGAATCCACTGCTCGAACCGTGACTAGGGTAACTTCTAATA - 720
    - *  L  D  F  R  I  L  N  P  L  L  E  P  *  L  G  *  L  L  I
    -  S  *  I  S  E  Y  *  I  H  C  S  N  R  D  *  G  N  F  *  Y
    -   A  R  F  Q  N  T  E  S  T  A  R  T  V  T  R  V  T  S  N  T
721 - CTTGTTTTGACCTTGTGATTCGTACCGTCACCACGTGAGGCACTTGAGTGAGCACTCGAG - 780
    - L  V  L  T  L  *  F  V  P  S  P  R  E  A  L  E  *  A  L  E
    -  L  F  *  P  C  D  S  Y  R  H  H  V  R  H  L  S  E  H  S  S
    -   C  F  D  L  V  I  R  T  V  T  T  *  G  T  *  V  S  T  R  V
781 - TTACCTCCACGTCAGTGAGCGATACAGCTGTTGTTAAAGACACCGGGTCTACCCATGGGA - 840
    - L  P  P  R  Q  *  A  I  Q  L  L  L  K  T  P  G  L  P  M  G
    -  Y  L  H  V  S  E  R  Y  S  C  C  *  R  H  R  V  Y  P  W  E
    -   T  S  T  S  V  S  D  T  A  V  V  K  D  T  G  S  T  H  G  R
841 - GAACTAACGTAGTTTCTAAAAGAGCGTGCGCGCCCGTTCAGTTACACGTGAGAAAGGCTT - 900
    - E  L  T  *  F  L  K  E  R  A  R  P  F  S  Y  T  *  E  R  L
    -  N  *  R  S  F  *  K  S  V  R  A  R  S  V  T  R  E  K  G  L
    -   T  N  V  V  S  K  R  A  C  A  P  V  Q  L  H  V  R  K  A  C
```

FIG. 5

```
 901 - GTTGAACTAATGTAGCTCAGCTTCTCTCCACAGATGACGACGGCACTGGTACTCGTACTT - 960
     -  V  E  L  M  *  L  S  F  S  P  Q  M  T  T  A  L  V  L  V  L
     -   L  N  *  C  S  S  A  S  L  H  R  *  R  R  H  W  Y  S  Y  F
     -    *  T  N  V  A  Q  L  L  S  T  D  D  D  G  T  G  T  R  T  L
 961 - TAACGGACCAAGTGACTCGCGAGACTATTCTCGATGCTCGTGGTCTGTGGGAAGCTTTAA - 1020
     -  *  R  T  K  *  L  A  R  L  F  S  M  L  V  V  C  G  K  L  *
     -   N  G  P  S  D  S  R  D  Y  S  R  C  S  W  S  V  G  S  F  N
     -    T  D  Q  V  T  R  E  T  I  L  D  A  R  G  L  W  E  A  L  I
1021 - TTCTCACGGTTCTTTAAACTGTGAAAGTTTCCCCTTACGGGTTTCAAACACAAAGGAGAA - 1080
     -  F  S  R  F  F  K  L  *  K  F  P  L  T  G  F  K  H  K  G  E
     -   S  H  G  S  L  N  C  E  S  F  P  L  R  V  S  N  T  K  E  N
     -    L  T  V  L  *  T  V  K  V  S  P  Y  G  F  Q  T  Q  R  R  I
1081 - TTGAGTTTTCAGTTTCAGTAAGTTGGTGCACAACTTTTCTTTTTCTGACTCCCAAAGTAC - 1140
     -  L  S  F  Q  F  Q  *  V  G  A  Q  L  F  F  F  *  L  P  K  Y
     -   *  V  F  S  F  S  K  L  V  H  N  F  S  F  S  D  S  Q  S  T
     -    E  F  S  V  S  V  S  W  C  T  T  F  L  F  L  T  P  K  V  P
1141 - CCCGCATATGCGAGACACATGGGACAACGTAGAGGTGTCCTCACATTGTTATACGTGAAC - 1200
     -  P  A  Y  A  R  H  M  G  Q  R  R  G  V  L  T  L  L  Y  V  N
     -   P  H  M  R  D  T  W  D  N  V  E  V  S  S  H  C  Y  T  *  T
     -    R  I  C  E  T  H  G  T  T  *  R  C  P  H  I  V  I  R  E  Q
1201 - AGATGGAACTACTTTACATTAGTAACGCTACTTCAAAGTACCGTCTGCACGCTGAAAGAC - 1260
     -  R  W  N  Y  F  T  L  V  T  L  L  Q  S  T  V  C  T  L  K  D
     -   D  G  T  T  L  H  *  *  R  Y  F  K  V  P  S  A  R  *  K  T
     -    M  E  L  L  Y  I  S  N  A  T  S  K  Y  R  L  H  A  E  R  L
1261 - TTTCGGTGAACACTTGTAACACCGTGACTTTTAAATCAATAACTTCCTGGATGATGTACA - 1320
     -  F  R  *  T  L  V  T  P  *  L  L  N  Q  *  L  P  G  *  C  T
     -   F  G  E  H  L  *  H  R  D  F  *  I  N  N  F  L  D  D  V  H
     -    S  V  N  T  C  N  T  V  T  F  K  S  I  T  S  W  M  M  Y  T
1321 - CCCATGGATGGATGATTACGACATCACTTTTACGGTACAGGACGGACAGTTCTGGGTCTC - 1380
     -  P  M  D  G  *  L  R  H  H  F  Y  G  T  G  R  T  V  L  G  L
     -   P  W  M  D  D  Y  D  I  T  F  T  V  Q  D  G  Q  F  W  V  S
     -    H  G  W  M  I  T  T  S  L  L  R  Y  R  T  D  S  S  G  S  L
1381 - TAACCTGGACTCGTATCACAACGTCTAATAGTGTTGGTGAGTTTGTAACTTTGAGCTGAG - 1440
     -  *  P  G  L  V  S  Q  R  L  I  V  L  V  S  L  *  L  *  A  E
     -   N  L  D  S  Y  H  N  V  *  *  C  W  *  V  C  N  F  E  L  R
     -    T  W  T  R  I  T  T  S  N  S  V  G  E  F  V  T  L  S  *  G
1441 - GCGTTCCCTCCATCCTGATCTACAAAACCTCCGACACACAAACGGATACAACCGACGATA - 1500
     -  A  F  P  P  S  *  S  T  K  P  P  T  H  K  R  I  Q  P  T  I
     -   R  S  L  H  P  D  L  Q  N  L  R  H  T  N  G  Y  N  R  R  Y
     -    V  P  S  I  L  I  Y  K  T  S  D  T  Q  T  D  T  T  D  D  I
1501 - TTATTCGCACGGATGACCCAAGGAGCACGATCACGACTATAACCGAGTCCGGTATGACCG - 1560
     -  L  F  A  R  M  T  Q  G  A  R  S  R  L  *  P  S  P  V  *  P
     -   Y  S  H  G  *  P  K  E  H  D  H  D  Y  N  R  V  R  Y  D  R
     -    I  R  T  D  D  P  R  S  T  I  T  T  I  T  E  S  G  M  T  V
1561 - TAATGACCACTGTTACACCTCTGGAACTTACTCCTAGAGGAACTCTATGACTCAGCACTT - 1620
     -  *  *  P  L  L  H  L  W  N  L  L  L  E  E  L  Y  D  S  A  L
     -   N  D  H  C  Y  T  S  G  T  Y  S  *  R  N  S  M  T  Q  H  L
     -    M  T  T  V  T  P  L  E  L  T  P  R  G  T  L  *  L  S  T  C
1621 - GCACAATTGTAATTGTAACAACCGCTAAAAGTAAACTTACTTCTCCAACGGTAGTAAAAC - 1680
     -  A  Q  L  *  L  *  Q  P  L  K  V  N  L  L  L  Q  R  *  *  N
     -   H  N  C  N  C  N  N  R  *  K  *  T  Y  F  S  N  G  S  K  T
     -    T  I  V  I  V  T  T  A  K  S  K  L  T  S  P  T  V  V  K  P
1681 - CGTAGAAAGAGACGAAGATGTTCACGGAAATAACTGTGATATTTCTCAGAACTAATGTTC - 1740
     -  R  R  K  R  R  R  C  S  R  K  *  L  *  Y  F  S  E  L  M  F
     -   V  E  R  D  E  D  V  H  G  N  N  C  D  I  S  Q  N  *  C  S
     -    *  K  E  T  K  M  F  T  E  I  T  V  I  F  L  R  T  N  V  Q
1741 - AGAAAGTTTTGGTAACAACTCAGGACGCCATTGATATTTCAATGGTTCCCTTTCGGGCAT - 1800
     -  R  K  F  W  *  Q  L  R  T  P  L  I  F  Q  W  F  P  F  G  H
     -   E  S  F  G  N  N  S  G  R  H  *  Y  F  N  G  S  L  S  G  I
     -    K  V  L  V  T  T  Q  D  A  I  D  I  S  M  V  P  F  R  A  F
```

FIG. 5 Cont'd

```
1801 - TTTCCACGAACCTTGTAACCTGTTGTCTCTAGTCAAAATTGTGGTGACACACCAAAAGGG - 1860
     -  F  P  R  T  L  *  P  V  V  S  S  Q  N  C  G  D  T  P  K  G
     -  F  H  E  P  C  N  L  L  S  L  V  K  I  V  V  T  H  Q  K  G
     -  S  T  N  L  V  T  C  C  L  *  S  K  L  W  *  H  T  K  R  E
1861 - AGTGTCCGACGACCACAATAGTCTAGTTAAAAACGCGCGTGTGAACTACGTCGTTGGTG - 1920
     -  S  V  R  R  P  Q  *  S  S  *  K  R  A  C  E  L  R  R  L  V
     -  V  S  D  D  H  N  S  L  V  K  N  A  R  V  N  Y  V  V  W  *
     -  C  P  T  T  T  I  V  *  L  K  T  R  V  *  T  T  S  F  G  E
1921 - AGTTAAGGACTAAACGTTTCTCGTCGACAGTGGTATGAACTACCATAAAGACTTGTCAGT - 1980
     -  S  *  G  L  N  V  S  R  R  Q  W  Y  E  L  P  *  R  L  V  S
     -  V  K  D  *  T  F  L  V  D  S  G  M  N  Y  H  K  D  L  S  V
     -  L  R  T  K  R  F  S  S  T  V  V  *  T  T  I  K  T  C  Q  *
1981 - AATGCAGAACAGCTGCGGTACCAAATATGAAGTCTGGACGAGTGGTTGTCACAGTAATAA - 2040
     -  N  A  E  Q  L  R  Y  Q  I  *  S  L  D  E  W  L  S  Q  *  *
     -  M  Q  N  S  C  G  T  K  Y  E  V  W  T  S  G  C  H  S  N  N
     -  C  R  T  A  A  V  P  N  M  K  S  G  R  V  V  V  T  V  I  I
2041 - TACCGTATACATTGACCACCAGAACATGTTGTCTGAAGAGTCACCAACAGATTAGAAAAC - 2100
     -  Y  R  I  H  *  P  P  E  H  V  V  *  R  V  T  N  R  L  E  N
     -  T  V  Y  I  D  H  Q  N  M  L  S  E  E  S  P  T  D  *  K  T
     -  P  Y  T  L  T  T  R  T  C  C  L  K  S  H  Q  Q  I  R  K  P
2101 - CCGTGATGACAACTTTTTGAGTCCGGATAGAAACTTACCTAACTCCGCTTTGAATCACGT - 2160
     -  P  *  *  Q  L  F  E  S  G  *  K  L  T  *  L  R  F  E  S  R
     -  R  D  D  N  F  L  S  P  D  R  N  L  P  N  S  A  L  N  H  V
     -  V  M  T  T  F  *  V  R  I  E  T  Y  L  T  P  L  *  I  T  S
2161 - CCTCAACTTAAAGAGTTCCTACGAACCCTCTAAGAGTTTAAAGAGTAATGTCCACAAAAA - 2220
     -  P  Q  L  K  E  F  L  R  T  L  *  E  F  K  E  *  C  P  Q  K
     -  L  N  L  K  S  S  Y  E  P  S  K  S  L  K  S  N  V  H  K  N
     -  S  T  *  R  V  P  T  N  P  L  R  V  *  R  V  M  S  T  K  T
2221 - CTGTAGCAGTTCCCAGTTTATGTCCAACGAAGTCTATTGTAGTTCCTAACACATTTTACG - 2280
     -  L  *  Q  F  P  V  Y  V  Q  R  S  L  L  *  F  L  T  H  F  T
     -  C  S  S  S  Q  F  M  S  N  E  V  Y  C  S  S  *  H  I  L  R
     -  V  A  V  P  S  L  C  P  T  K  S  I  V  V  P  N  T  F  Y  E
2281 - AAGTAACTACAACAATTGTTCCGTGAGCTTTACACGTAACTAGTTCAGTGATAGCGACCG - 2340
     -  K  *  L  Q  Q  L  F  R  E  L  Y  T  *  L  V  Q  *  *  R  P
     -  S  N  Y  N  N  C  S  V  S  F  T  R  N  *  F  S  D  S  D  R
     -  V  T  T  T  I  V  P  *  A  L  H  V  T  S  S  V  I  A  T  A
2341 - CGTTTCAACGCTAGTGAGTTGAATCCACTTCAGAAGTAGCGAGTTTCGTTCCCTGAAATG - 2400
     -  R  F  N  A  S  E  L  N  P  L  Q  K  *  R  V  S  F  P  E  M
     -  V  S  T  L  V  S  *  I  H  F  R  S  S  E  F  R  S  L  K  W
     -  F  Q  R  *  *  V  E  S  T  S  E  V  A  S  F  V  P  *  N  G
2401 - GCAGTCACATATGCACCGTTCCTCGTCGACGTTGATGAGTACGGAGAATTCCGTGGTTTT - 2460
     -  A  V  T  Y  A  P  F  L  V  D  V  D  E  Y  G  E  F  R  G  F
     -  Q  S  H  M  H  R  S  S  S  T  L  M  S  T  E  N  S  V  V  F
     -  S  H  I  C  T  V  P  R  R  R  *  *  V  R  R  I  P  W  F  S
2461 - CTTCATTGGAAAGAACTTCCACTAAGTGTACTGTGTCATGAATGGAGACTCCTCCAACAA - 2520
     -  L  H  W  K  E  L  P  L  S  V  L  C  H  E  W  R  L  L  Q  Q
     -  F  I  G  K  N  F  H  *  V  Y  C  V  M  N  G  D  S  S  N  K
     -  S  L  E  R  T  S  T  K  C  T  V  S  *  M  E  T  P  P  T  R
2521 - GAGTTCTTGCCACTTGAGCTTCGTGAGCTCTGCGGGCAACTATCGAAGTGTTTACCTCGA - 2580
     -  E  F  L  P  L  E  L  R  E  L  C  G  Q  L  S  K  C  L  P  R
     -  S  S  C  H  L  S  F  V  S  S  A  G  N  Y  R  S  V  Y  L  D
     -  V  L  A  T  *  A  S  *  A  L  R  A  T  I  E  V  F  T  S  I
2581 - TAGCAACCGTGTGGTCAGACACATTTACCGGAGTACGAGAATCTCTAATTCCTGTTTCTT - 2640
     -  *  Q  P  C  G  Q  T  H  L  P  E  Y  E  N  L  *  F  L  F  L
     -  S  N  R  V  V  R  H  I  Y  R  S  T  R  I  S  N  S  C  F  L
     -  A  T  V  W  S  D  T  F  T  G  V  R  E  S  L  I  P  V  S  C
2641 - GTTATGACGCGTAACAGAGGACCAAATGACCGATGTTTGTTACAGAAAGCGAATTTTCCC - 2700
     -  V  M  T  R  N  R  G  P  N  D  R  C  L  L  Q  K  A  N  F  P
     -  L  *  R  V  T  E  D  Q  M  T  D  V  C  Y  R  K  R  I  F  P
     -  Y  D  A  *  Q  R  T  K  *  P  M  F  V  T  E  S  E  F  S  P
```

FIG. 5 Cont'd

```
2701 - CCACGTGGTTAATTTCCACATTGGAAACCTCTTCTATGACAAACCCTTCAAGTTCCAATG - 2760
     - P  R  G  *  F  P  H  W  K  P  L  L  *  Q  T  L  Q  V  P  M
     -  H  V  V  N  F  H  I  G  N  L  F  Y  D  K  P  F  K  F  Q  C
     -   T  W  L  I  S  T  L  E  T  S  S  M  T  N  P  S  S  S  N  V
2761 - TTCTTACACTCTTAGTGTAAACTCGAACTACTTGCACAACTGTTTCACGAATTACTTTTC - 2820
     - F  L  H  S  *  C  K  L  E  L  L  A  Q  L  F  H  E  L  L  F
     -  S  Y  T  L  S  V  N  S  N  Y  L  H  N  C  F  T  N  Y  F  S
     -   L  T  L  L  V  *  T  R  T  T  C  T  T  V  S  R  I  T  F  H
2821 - ACGAGACAGATGTGACAACTTAGGCCATGGCTTCAATGACTCAAACGTACACAACATCGT - 2880
     - T  R  Q  M  *  Q  L  R  P  W  L  Q  *  L  K  R  T  Q  H  R
     -  R  D  R  C  D  N  L  G  H  G  F  N  D  S  N  V  H  N  I  V
     -   E  T  D  V  T  T  *  A  M  A  S  M  T  Q  T  Y  T  T  S  S
2881 - CTCCGACAACACTTCTGAAATGTTGGTCAAAGACTAGAGGAATGGTTGTACCCATAACTA - 2940
     - L  R  Q  H  F  *  N  V  G  Q  R  L  E  E  W  L  Y  P  *  L
     -  S  D  N  T  S  E  M  L  V  K  D  *  R  N  G  C  T  H  N  *
     -   P  T  T  L  L  K  C  W  S  K  T  R  G  M  V  V  P  I  T  R
2941 - GAACTACTCACCTCACATCGATGTAAGATGAATAAACTACTACGACCACTTCTTTTGAAA - 3000
     - E  L  L  T  S  H  R  C  K  M  N  K  L  L  R  P  L  L  L  K
     -  N  Y  S  P  H  I  D  V  R  *  I  N  Y  Y  D  H  F  F  *  K
     -   T  T  H  L  T  S  M  *  D  E  *  T  T  T  T  T  S  F  E  K
3001 - AGTAGTGCATACATAACAAGGAAAATGGGAGGTCTACTCCTTCTTCTCCTGCTACGTCTC - 3060
     - S  S  A  Y  I  T  R  K  M  G  G  L  L  L  L  L  L  R  L
     -  V  V  H  T  *  Q  G  K  W  E  V  Y  S  F  F  S  C  Y  V  S
     -   *  C  I  H  N  K  E  N  G  R  S  T  P  S  S  P  A  T  S  H
3061 - ACACTCCTTCTTCTTTAACTACTTTGGACACTTGTACTCATGCCATGTCTCCTACTAATA - 3120
     - T  L  L  L  L  *  L  L  W  T  L  V  L  M  P  C  L  L  L  I
     -  H  S  F  F  F  N  Y  F  G  H  L  Y  S  C  H  V  S  Y  *  *
     -   T  P  S  S  L  T  T  L  D  T  C  T  H  A  M  S  P  T  N  S
3121 - GTTCCAGAGGGAGACCTTAAACCACGGAGTCGACTTTGTCAAGCTCAACTCCTTCTTCTT - 3180
     - V  P  E  G  D  L  K  P  R  S  R  L  C  Q  A  Q  L  L  L  L
     -  F  Q  R  E  T  L  N  H  G  V  D  F  V  K  L  N  S  F  F  F
     -   S  R  G  R  P  *  T  T  E  S  T  L  S  S  S  T  P  S  S  S
3181 - CTCCTTCTGACCGACCTACTATGATGACTCGTTAGTCTCTAACTCGGTCTTGGTCTTGGA - 3240
     - L  L  L  T  D  L  L  *  *  L  V  S  L  *  L  G  L  G  L  G
     -  S  F  *  P  T  Y  Y  D  D  S  L  V  S  N  S  V  L  V  L  D
     -   P  S  D  R  P  T  M  M  T  R  *  S  L  T  R  S  W  S  W  M
3241 - TGTGGACTTCTTGGTCAATTAGTCAAATGACCAATAAATTTTGAATGACTGTTACAACGG - 3300
     - C  G  L  L  G  Q  L  V  K  *  P  I  N  F  E  *  L  L  Q  R
     -  V  D  F  L  V  N  *  S  N  D  Q  *  I  L  N  D  C  Y  N  G
     -   W  T  S  W  S  I  S  Q  M  T  N  K  F  *  M  T  V  T  T  V
3301 - TAATTTACACAACTGTAGCAATTCCTCCGTGTTTCACGATTAGGATACCACTAACATTTA - 3360
     - *  F  T  Q  L  *  Q  F  L  R  V  S  R  L  G  Y  H  *  H  L
     -  N  L  H  N  C  S  N  S  S  V  F  H  D  *  D  T  T  N  I  Y
     -   I  Y  T  T  V  A  I  P  P  C  F  T  I  R  I  P  L  T  F  T
3361 - CGACGATTGTATGTGGACTTTGTACCACCACCACATCGTCCACGTGAGTTGTTCCGTTGG - 3420
     - R  R  L  Y  V  D  F  V  P  P  P  H  R  P  R  E  L  F  R  W
     -  D  D  C  M  W  T  L  Y  H  H  H  I  V  H  V  S  C  S  V  G
     -   T  I  V  C  G  L  C  T  T  T  T  S  S  T  *  V  V  P  L  V
3421 - TTACCACGGTACGTTTTCCTCTCACTACTAATGTAATTCGATTTACCGGGAGAATGTCAT - 3480
     - L  P  R  Y  V  F  L  S  L  L  M  *  F  D  L  P  G  E  C  H
     -  Y  H  G  T  F  S  S  H  Y  *  C  N  S  I  Y  R  E  N  V  I
     -   T  T  V  R  F  P  L  T  T  N  V  I  R  F  T  G  R  M  S  S
3481 - CCTCCCAGAACAAACGAAAGACCTGTATTAGAACGATTCTTCACAGACGTACAACAACCT - 3540
     - P  P  R  T  N  E  R  P  V  L  E  R  F  F  T  D  V  Q  Q  P
     -  L  P  E  Q  T  K  D  L  Y  *  N  D  S  S  Q  T  Y  N  N  L
     -   S  Q  N  K  R  K  T  C  I  R  T  I  L  H  R  R  T  T  T  W
3541 - GGATTGGATTTACGTCCACTCCTGTAGGTCGAAGAATTCCGTCGTATACTTTTAAAGTTA - 3600
     - G  L  D  L  R  P  L  L  *  V  E  E  F  R  R  I  L  L  K  L
     -  D  W  I  Y  V  H  S  C  R  S  K  N  S  V  V  Y  F  *  S  *
     -   I  G  F  T  S  T  P  V  G  R  R  I  P  S  Y  T  F  K  V  K
```

FIG. 5 Cont'd

```
3601 - AGTGTCCTGTAGAATGAACGTGGTAACAACAGTCGTCCGTATAAACCACGATTTGGTGAA - 3660
      - S  V  L  *  N  E  R  G  N  N  S  R  P  Y  K  P  R  F  G  E
      - V  S  C  R  M  N  V  V  T  T  V  V  R  I  N  H  D  L  V  K
      - C  P  V  E  *  T  W  *  Q  Q  S  S  V  *  T  T  I  W  *  S
3661 - GTCAGAAATGTTCACACGCACGTCTGCCAAGCATGTGTCCAAATATAACGTCAGTTACTG - 3720
      - V  R  N  V  H  T  H  V  C  Q  A  C  V  Q  I  *  R  Q  L  L
      - S  E  M  F  T  R  T  S  A  K  H  V  S  K  Y  N  V  S  Y  C
      - Q  K  C  S  H  A  R  L  P  S  M  C  P  N  I  T  S  V  T  V
3721 - TTTCGAGAAATACTCGTCCAACAGTACCTAATAGAACTATTGGACTTCGGATCTCACCTT - 3780
      - F  R  E  I  L  V  Q  Q  Y  L  I  E  L  L  D  F  G  S  H  L
      - F  E  K  Y  S  S  N  S  T  *  *  N  Y  W  T  S  D  L  T  F
      - S  R  N  T  R  P  T  V  P  N  R  T  I  G  L  R  I  S  P  S
3781 - CGTGGATTTGTTCTCCTCGGTGGTTTGTGTCTTCTAAGGTTTTGACTCCTCTTTAGACAG - 3840
      - R  G  F  V  L  L  G  G  L  C  L  L  R  F  *  L  L  F  R  Q
      - V  D  L  F  S  S  V  V  C  V  F  *  G  F  D  S  S  L  D  S
      - W  I  C  S  P  R  W  F  V  S  S  K  V  L  T  P  L  *  T  A
3841 - CATGTCTTCGGACAGCTACACTTCGGTTTTTAATTCCGGACGTAACTACTCCAATGGTGT - 3900
      - H  V  F  G  Q  L  H  F  G  F  *  F  R  T  *  L  L  Q  W  C
      - M  S  S  D  S  Y  T  S  V  F  N  S  G  R  N  Y  S  N  G  V
      - C  L  R  T  A  T  L  R  F  L  I  P  D  V  T  T  P  M  V  L
3901 - TGTGACCTTCTTTGATTCAAAGAATGGTTATTCAATGAGAACAAACGACTATAGTTACCA - 3960
      - C  D  L  L  *  F  K  E  W  L  F  N  E  N  K  R  L  *  L  P
      - V  T  F  F  D  S  K  N  G  Y  S  M  R  T  N  D  Y  S  Y  H
      - *  P  S  L  I  Q  R  M  V  I  Q  *  E  Q  T  T  I  V  T  I
3961 - TTCGAAATGGTACTAAGAGTCTTGTACGAATCTCCACTTCTATACAGAAAGGAACTCTTC - 4020
      - F  E  M  V  L  R  V  L  Y  E  S  P  L  L  Y  R  K  E  L  F
      - S  K  W  Y  *  E  S  C  T  N  L  H  F  Y  T  E  R  N  S  S
      - R  N  G  T  K  S  L  V  R  I  S  T  S  I  Q  K  G  T  L  P
4021 - CTACGTGGAATGTACCATCCACTACAATAGTGATCACCACTATAGTGAACACAACATTAT - 4080
      - L  R  G  M  Y  H  P  L  Q  *  *  S  P  L  *  *  T  Q  H  Y
      - Y  V  E  C  T  I  H  Y  N  S  D  H  H  Y  S  E  H  N  I  M
      - T  W  N  V  P  S  T  T  I  V  I  T  T  I  V  N  T  T  L  W
4081 - GGGAGGTTTTTCCGACCACCGTGATGACTCTACGAGAGTTCTCGAAACTTCTTTCACGGT - 4140
      - G  R  F  F  R  P  P  *  *  L  Y  E  S  S  R  N  F  F  H  G
      - G  G  F  S  D  H  R  D  D  S  T  R  V  L  E  T  S  F  T  V
      - E  V  F  P  T  T  V  M  T  L  R  E  F  S  K  L  L  S  R  S
4141 - CAACTACTCATATATTGGTGCATGGGACCTGTTCCTACACGACCAATATGTGAACTCCTT - 4200
      - Q  L  L  I  Y  W  C  M  G  P  V  P  T  R  P  I  C  E  L  L
      - N  Y  S  Y  I  G  A  W  D  L  F  L  H  D  Q  Y  V  N  S  F
      - T  T  H  I  L  V  H  G  T  C  S  Y  T  T  N  M  *  T  P  S
4201 - CGATTCTGACGAGAATTCTTTACGTTTAGACGTAAAATACATGATGGAAGTCTTCGTGGA - 4260
      - R  F  *  R  E  F  F  T  F  R  R  K  I  H  D  G  S  L  R  G
      - D  S  D  E  N  S  L  R  L  D  V  K  Y  M  M  E  V  F  V  D
      - I  L  T  R  I  L  Y  V  *  T  *  N  T  *  W  K  S  S  W  I
4261 - TTACGATTCCTTCTCTAAGATCCTTGACATAGGACCTTAAACTCTCTTTACGAACGAGTA - 4320
      - L  R  F  L  L  *  D  P  *  H  R  T  L  N  S  L  Y  E  R  V
      - Y  D  S  F  S  K  I  L  D  I  G  P  *  T  L  F  T  N  E  Y
      - T  I  P  S  L  R  S  L  T  *  D  L  K  L  S  L  R  T  S  T
4321 - CGACTTCTCTGTTCTTTTAATTACGGATATACGTACCTACAATCTCGGTATTACCGTTGG - 4380
      - R  L  L  C  S  F  N  Y  G  Y  T  Y  L  Q  S  R  Y  Y  R  W
      - D  F  S  V  L  L  I  T  D  I  R  T  Y  N  L  G  I  T  V  G
      - T  S  L  F  F  *  L  R  I  Y  V  P  T  I  S  V  L  P  L  V
4381 - TAGGTTGCATTCATATTTCCTTAATTTTAAGTTCTCCCGTAGCAACTGATACCACAGGCT - 4440
      - *  V  A  F  I  F  P  *  F  *  V  L  P  *  Q  L  I  P  Q  A
      - R  L  H  S  Y  F  L  N  F  K  F  S  R  S  N  *  Y  H  R  L
      - G  C  I  H  I  S  L  I  L  S  S  P  V  A  T  D  T  T  G  *
4441 - AAGAAGAAAATATGATCATTTCTCGGACATCGAAGATAATAATGCTTCGACTTGAGAGAT - 4500
      - K  K  K  I  *  S  F  L  G  H  R  R  *  *  C  F  D  L  R  D
      - R  R  K  Y  D  H  F  S  D  I  E  D  N  N  A  S  T  *  E  I
      - E  E  N  M  I  I  S  R  T  S  K  I  I  M  L  R  L  E  R  F
```

FIG. 5 Cont'd

```
4501 - TTACTCGGCGAACAGTGTTACGGTTAACCAATACACTGTGTACCAAAATTAGAACTTCTC - 4560
     - L  L  G  E  Q  C  Y  G  *  P  I  H  C  V  P  K  L  E  L  L
     - Y  S  A  N  S  V  T  V  N  Q  Y  T  V  Y  Q  N  *  N  F  S
     - T  R  R  T  V  L  R  L  T  N  T  L  C  T  K  I  R  T  S  P
4561 - CGACGCGCGACATACGCAAGAGAATTTCGAGGACGGCATCACAGTCATAGTAGTGGTCTA - 4620
     - R  R  A  T  Y  A  R  E  F  R  G  R  H  H  S  H  S  S  G  L
     - D  A  R  H  T  Q  E  N  F  E  D  G  I  T  V  I  V  V  V  Y
     - T  R  D  I  R  K  R  I  S  R  T  A  S  Q  S  *  *  W  S  T
4621 - CGACAATGATGTATATTACCTATGGAGTGAAGCAGTAGTTTCTGTAGACTCCTCGTGAAA - 4680
     - R  Q  *  C  I  L  P  M  E  *  S  S  S  F  C  R  L  L  V  K
     - D  N  D  V  Y  Y  L  W  S  E  A  V  V  S  V  D  S  S  *  N
     - T  M  M  Y  I  T  Y  G  V  K  Q  *  F  L  *  T  P  R  E  T
4681 - CATCTTTGTCAAAGAAACCGACCGAGAATGTCTCTAACCAGGATAAGTCCTGTCGCATGT - 4740
     - H  L  C  Q  R  N  R  P  R  M  S  L  T  R  I  S  P  V  A  C
     - I  F  V  K  E  T  D  R  E  C  L  *  P  G  *  V  L  S  H  V
     - S  L  S  K  K  P  T  E  N  V  S  N  Q  D  K  S  C  R  M  S
4741 - CTCAATCCACAACTTAAAGAATTCGCACCACTGTTTTAACACATGGTGTGAGACCTCTCG - 4800
     - L  N  P  Q  L  K  E  F  A  P  L  F  *  H  M  V  *  D  L  S
     - S  I  H  N  L  K  N  S  H  H  C  F  N  T  W  C  E  T  S  R
     - Q  S  T  T  *  R  I  R  T  T  V  L  T  H  G  V  R  P  L  G
4801 - GGGCAGCTCAAAGTAGAACTGCCACTCCAAGAAAGTGAACTGTTTGATTTCTCAGAGAAT - 4860
     - G  Q  L  K  V  E  L  P  L  Q  E  S  E  L  F  D  F  S  E  N
     - G  S  S  K  *  N  C  H  S  K  K  V  N  C  L  I  S  Q  R  I
     - A  A  Q  S  R  T  A  T  P  R  K  *  T  V  *  F  L  R  E  *
4861 - AGGGACGCCCTCCAATTCTGATATTTTCACAAGTGTTGACACCTGTTGTGATTAGAGGTG - 4920
     - R  D  A  L  Q  F  *  Y  F  H  K  C  *  H  L  L  *  L  E  V
     - G  T  P  S  N  S  D  I  F  T  S  V  D  T  C  C  D  *  R  C
     - G  R  P  P  I  L  I  F  S  Q  V  L  T  P  V  V  I  R  G  V
4921 - TGTGTCGAACACCTATACAGATACTGTATACCTGTCGTCAAACCAGGTTGTATGAACCTA - 4980
     - C  V  E  H  L  Y  R  Y  C  I  P  V  V  K  P  G  C  M  N  L
     - V  S  N  T  Y  T  D  T  V  Y  L  S  S  N  Q  V  V  *  T  Y
     - C  R  T  P  I  Q  I  L  Y  T  C  R  Q  T  R  L  Y  E  P  T
4981 - CCACGACTACAATGTTTTTAATTTGGAGTACATTTAGTACTCCCATTCTGAAAGAAACAT - 5040
     - P  R  L  Q  C  F  *  F  G  V  H  L  V  L  P  F  *  K  K  H
     - H  D  Y  N  V  F  N  L  E  Y  I  *  Y  S  H  S  E  R  N  M
     - T  T  T  M  F  L  I  W  S  T  F  S  T  P  I  L  K  E  T  *
5041 - GATGGATCACTACTGTGTGATGCATCACTTCGAAAGCTCATGATGGTATGAGAACTACTC - 5100
     - D  G  S  L  L  C  D  A  S  L  R  K  L  M  M  V  *  E  L  L
     - M  D  H  Y  C  V  M  H  H  F  E  S  S  *  W  Y  E  N  Y  S
     - W  I  T  T  V  *  C  I  T  S  K  A  H  D  G  M  R  T  T  L
5101 - TCAAAAGAACCATCCATGTACAGACGAAATTTGGTGTGTTTCTTTACCTTTAAAGGAGTT - 5160
     - S  K  E  P  S  M  Y  R  R  N  L  V  C  F  F  T  F  K  G  V
     - Q  K  N  H  P  C  T  D  E  I  W  C  V  S  L  P  L  K  E  F
     - K  R  T  I  H  V  Q  T  K  F  G  V  F  L  Y  L  *  R  S  S
5161 - CAACCACCAAATTGAAGTTAATTTACCCGACTATTGTTAACAATAAACAGATCACAAAAT - 5220
     - Q  P  P  N  *  S  *  F  T  R  L  L  L  T  I  N  R  S  Q  N
     - N  H  Q  I  E  V  N  L  P  D  Y  C  *  Q  *  T  D  H  K  I
     - T  T  K  L  K  L  I  Y  P  T  I  V  N  N  K  Q  I  T  K  *
5221 - AATCGTGAAGTTGTCGAACTTCAGTTTAAGTTACGTGGTCGTGAAGTTCTCCGAATAATA - 5280
     - N  R  E  V  V  E  L  Q  F  K  L  R  G  R  E  V  L  R  I  I
     - I  V  K  L  S  N  F  S  L  S  Y  V  V  V  K  F  S  E  *  Y
     - S  *  S  C  R  T  S  V  *  V  T  W  S  *  S  S  P  N  N  I
5281 - TCTCGGGCACGACCACTACGACGATTGAAAACACGTGAGTATGAGCGAATGTCATTATTT - 5340
     - S  R  A  R  P  L  R  R  L  K  T  R  E  Y  E  R  M  S  L  F
     - L  G  H  D  H  Y  D  D  *  K  H  V  S  M  S  E  C  H  Y  F
     - S  G  T  T  T  T  T  I  E  N  T  *  V  *  A  N  V  I  I  L
5341 - TGACAACCGCTCGAACCACTACAGTCTCTTTGATACTGGGTAGAAGATGTCGTACGATTA - 5400
     - *  Q  P  L  E  P  L  Q  S  L  *  Y  W  V  E  D  V  V  R  L
     - D  N  R  S  N  H  Y  S  L  F  D  T  G  *  K  M  S  Y  D  *
     - T  T  A  R  T  T  T  V  S  L  I  L  G  R  R  C  R  T  I  K
```

FIG. 5 Cont'd

```
5401 - AACCTTAGACGTTTCGCTCAAGAATTACACCACACATTTGTAACACCAGTCTTTTGATGA - 5460
     - N  L  R  R  F  A  Q  E  L  H  H  T  F  V  T  P  V  F  *  *
     -  T  L  D  V  S  L  K  N  Y  T  T  H  L  *  H  Q  S  F  D  D
     -   P  *  T  F  R  S  R  I  T  P  H  I  C  N  T  S  L  L  M  M
5461 - TGGAATTGCCCACATCTTCGACACTACATATACCCATGAGATAGAATACTATTAGAATTC - 5520
     - W  N  C  P  H  L  R  H  Y  I  Y  P  *  D  R  I  L  L  E  F
     -  G  I  A  H  I  F  D  T  T  Y  T  H  E  I  E  Y  Y  *  N  S
     -   E  L  P  T  S  S  T  L  H  I  P  M  R  *  N  T  I  R  I  L
5521 - TGTCCACAAAGGTAAGGTACACACACACCAGCACTACGATGTGTTATAGATCATGTTGTT - 5580
     - C  P  Q  R  *  G  T  H  T  P  A  L  R  C  V  I  D  H  V  V
     -  V  H  K  G  K  V  H  T  H  Q  H  Y  D  V  L  *  I  M  L  F
     -   S  T  K  V  R  Y  T  H  T  S  T  T  M  C  Y  R  S  C  C  S
5581 - CTCAGAAGAAAACAATACTACAGACGTGGTGGACGACTCATATTTAATGTCGTTCCATGT - 5640
     - L  R  R  K  Q  Y  Y  R  R  G  G  R  L  I  F  N  V  V  P  C
     -  S  E  E  N  N  T  T  D  V  V  D  D  S  Y  L  M  S  F  H  V
     -   Q  K  K  T  I  L  Q  T  W  W  T  T  H  I  *  C  R  S  M  *
5641 - AAGAATACACGCTTACTCATGTGACCATTGATAGTCACACCAGTAATGTGAGTATATTGA - 5700
     - K  N  T  R  L  L  M  *  P  L  I  V  T  P  V  M  *  V  Y  *
     -  R  I  H  A  Y  S  C  D  H  *  *  S  H  Q  *  C  E  Y  I  D
     -   E  Y  T  L  T  H  V  T  I  D  S  H  T  S  N  V  S  I  L  T
5701 - CGATTCCTCTGGGAGATAGCATAACTGCCTCGAGTGGAATGTTTCTACAGTCTCATGTTT - 5760
     - R  F  L  W  E  I  A  *  L  P  R  V  E  C  F  Y  S  L  M  F
     -  D  S  S  G  R  *  H  N  C  L  E  W  N  V  S  T  V  S  C  F
     -   I  P  L  G  D  S  I  T  A  S  S  G  M  F  L  Q  S  H  V  S
5761 - CCTGGTCACTGACTACAAAAGATGTTCCTTTGTAGAATGTGATGTTGGTAGTTCGGACAC - 5820
     - P  G  H  *  L  Q  K  M  F  L  C  R  M  *  C  W  *  F  G  H
     -  L  V  T  D  Y  K  R  C  S  F  V  E  C  D  V  G  S  S  D  T
     -   W  S  L  T  T  K  D  V  P  L  *  N  V  M  L  V  V  R  T  Q
5821 - AGCATATTTGAGCTACCTCAATGAATGTGTCTCTAACTTGGTTTTAACCTACCCATAATA - 5880
     - S  I  F  E  L  P  Q  *  M  C  L  *  L  G  F  N  L  P  I  I
     -  A  Y  L  S  Y  L  N  E  C  V  S  N  L  V  L  T  Y  P  *  Y
     -   H  I  *  A  T  S  M  N  V  S  L  T  W  F  *  P  T  H  N  I
5881 - TTTTTCCTATTACGAATGATATGTCTCGTCGGATATCTGGAACATGGTTGAGTTGGTAAT - 5940
     - F  F  L  L  R  M  I  C  L  V  G  Y  L  E  H  G  *  V  G  N
     -  F  S  Y  Y  E  *  Y  V  S  S  D  I  W  N  M  V  E  L  V  M
     -   F  P  I  T  N  D  M  S  R  R  I  S  G  T  W  L  S  W  *  W
5941 - GGTTTACGCTCAAAACTATTAAAGTTTGAGTGTACAAGATTGTGTTTTAAACGACTACTA - 6000
     - G  L  R  S  K  L  L  K  F  E  C  T  R  L  C  F  K  R  L  L
     -  V  Y  A  Q  N  Y  *  S  L  S  V  Q  D  C  V  L  N  D  Y  *
     -   F  T  L  K  T  I  K  V  *  V  Y  K  I  V  F  *  T  T  T  K
6001 - AATTTAGTTTACTGTCCGAAGTGTTTCGGTCGAAGTGCTCTCGATAGACAGTGTAAGAAG - 6060
     - N  L  V  Y  C  P  K  C  F  G  R  S  A  L  D  R  Q  C  K  K
     -  I  *  F  T  V  R  S  V  S  V  E  V  L  S  I  D  S  V  R  R
     -   F  S  L  L  S  E  V  F  R  S  K  C  S  R  *  T  V  *  E  G
6061 - GGTCTGAACTTACCGCTACATCACCGATAACTGATATCTGTGATAAGTCGCTCAAAGTTC - 6120
     - G  L  N  L  P  L  H  H  R  *  L  I  S  V  I  S  R  S  K  F
     -  V  *  T  Y  R  Y  I  T  D  N  *  Y  L  *  *  V  A  Q  S  S
     -   S  E  L  T  A  T  S  P  I  T  D  I  C  D  K  S  L  K  V  L
6121 - TTTCCACGATTTAATGACGTATTCGGTTAACAAACCGTGTAATTGGTCCGATGTTGGTTC - 6180
     - F  P  R  F  N  D  V  F  G  *  Q  T  V  *  L  V  R  C  W  F
     -  F  H  D  L  M  T  Y  S  V  N  K  P  C  N  W  S  D  V  G  S
     -   S  T  I  *  *  R  I  R  L  T  N  R  V  I  G  P  M  L  V  L
6181 - TGTTGCAAGTTTGGTTTGTGAACCACAAATGCAACAGAAACCTCATGTTTCGGTCATCTA - 6240
     - C  C  K  F  G  L  *  T  T  N  A  T  E  T  S  C  F  G  H  L
     -  V  A  S  L  V  C  E  P  Q  M  Q  Q  K  P  H  V  S  V  I  Y
     -   L  Q  V  W  F  V  N  H  K  C  N  R  N  L  M  F  R  S  S  M
6241 - TGAAGTTTAAGTAAACTTCAAGACCGTCATCTTCTGTGTGTTCCTTACCTGTTAGAACGA - 6300
     - *  S  L  S  K  L  Q  D  R  H  L  L  C  V  P  Y  L  L  E  R
     -  E  V  *  V  N  F  K  T  V  I  F  C  V  F  L  T  C  *  N  E
     -   K  F  K  *  T  S  R  P  S  S  S  V  C  S  L  P  V  R  T  N
```

FIG. 5 Cont'd

```
6301 - ACACTTTCAGTTGTTGGGTGGAGACTTCTTCATCACCTTTTAGGATGGTATGTCTTCCTT - 6360
       - T  L  S  V  V  G  W  R  L  L  H  H  L  L  G  W  Y  V  F  L
       - H  F  Q  L  L  G  G  D  F  F  I  T  F  *  D  G  M  S  S  F
       -  T  F  S  C  W  V  E  T  S  S  P  F  R  M  V  C  L  P  S
6361 - CAGTATCTCACACTGCACTTTTGATGGCTTCAACATCCGTTACAGTATGAATTTGGTAGT - 6420
       - Q  Y  L  T  L  H  F  *  W  L  Q  H  P  L  Q  Y  E  F  G  S
       - S  I  S  H  C  T  F  D  G  F  N  I  R  Y  S  M  N  L  V  V
       -  V  S  H  T  A  L  L  M  A  S  T  S  V  T  V  *  I  W  *  S
6421 - CTACTTCCACAATTTCATTGTGTTCTCAATCCAGTACTCCTAGAATACCGACGAATACAC - 6480
       - L  L  P  Q  F  H  C  V  L  N  P  V  L  L  E  Y  R  R  I  H
       - Y  F  H  N  F  I  V  F  S  I  Q  Y  S  *  N  T  D  E  Y  T
       -  T  S  T  I  S  L  C  S  Q  S  S  T  P  R  I  P  T  N  T  P
6481 - CTTTTGTGTTCGTAATGGTAATTCTTTGGATTACTCGAAAGTGATCGGAATCCAAATTTT - 6540
       - L  L  C  S  *  W  *  F  F  G  L  L  E  S  D  R  N  P  N  F
       - F  C  V  R  N  G  N  S  L  D  Y  S  K  V  I  G  I  Q  I  F
       -  F  V  F  V  M  V  I  L  W  I  T  R  K  *  S  E  S  K  F  L
6541 - TGTTAACGGTGAGTACCATAACGACGTTAATTATCACAAGGAACCTCATTTTAAAACCGA - 6600
       - C  *  R  *  V  P  *  R  R  *  L  S  Q  G  T  S  F  *  N  R
       - V  N  G  E  Y  H  N  D  V  N  Y  H  K  E  P  H  F  K  T  E
       -  L  T  V  S  T  I  T  T  L  I  I  T  R  N  L  I  L  K  P  N
6601 - ATACAGTTTGGTAAGAATCCTGTTCGTCGTTAATGTTGTAGTTTAACGCGATTCTCTAAT - 6660
       - I  Q  F  G  K  N  P  V  R  R  *  C  C  S  L  T  R  F  S  N
       - Y  S  L  V  R  I  L  F  V  V  N  V  V  V  *  R  D  S  L  I
       -  T  V  W  *  E  S  C  S  S  L  M  L  *  F  N  A  I  L  *  S
6661 - CGTGTTGCACACACAAATTGTTAATATACGGAATACACAAATGTAATAACAAGGTTAACACA - 6720
       - R  V  A  H  K  L  L  I  Y  G  I  H  K  C  N  N  K  V  N  T
       - V  L  H  T  N  C  *  Y  T  E  Y  T  N  V  I  T  R  L  T  H
       -  C  C  T  Q  I  V  N  I  R  N  T  Q  M  *  *  Q  G  *  H  M
6721 - TGAAAATGATTTTCATGGTTAAGATCTTAATCTCGAAGTGATGGATGTTGATAACGATTT - 6780
       - *  K  *  F  S  W  L  R  S  *  S  R  S  D  G  C  *  *  R  F
       - E  N  D  F  H  G  *  D  L  N  L  E  V  M  D  V  D  N  D  F
       -  K  M  I  F  M  V  K  I  L  I  S  K  *  W  M  L  I  T  I  F
6781 - TTATCACAATTCTCACAACGATTTAATACAAACCTACGGCCGTAATTAATACACTTCAGT - 6840
       - L  S  Q  F  S  Q  R  F  N  T  N  L  R  P  *  L  I  H  F  S
       - Y  H  N  S  H  N  D  L  I  Q  T  Y  G  R  N  *  Y  T  S  V
       -  I  T  I  L  T  T  I  *  Y  K  P  T  A  V  I  N  T  L  Q  W
6841 - GGGTTTAAAAGATTTAACAAGTGTTAGCGATACACCGATAACAACAATTCATAAACGAAT - 6900
       - G  F  K  R  F  N  K  C  *  R  Y  T  D  N  N  N  S  *  T  N
       - G  L  K  D  L  T  S  V  S  D  T  P  I  T  T  I  H  K  R  I
       -  V  *  K  I  *  Q  V  L  A  I  H  R  *  Q  Q  F  I  N  E  S
6901 - CCAAGAGATTAGACACATTGACGACGAAAACCACATGAGAATAGATTAAAACCACGAGGA - 6960
       - P  R  D  *  T  H  *  R  R  K  P  H  E  N  R  L  K  P  R  G
       - Q  E  I  R  H  I  D  D  E  N  H  M  R  I  D  *  N  H  E  E
       -  K  R  L  D  T  L  T  T  K  T  T  *  E  *  I  K  T  T  R  K
6961 - AGAATAACATTACCGCAATCTCTTAACATAGAATTAAGCAGATTGCAATGATGATACCTA - 7020
       - R  I  T  L  P  Q  S  L  N  I  E  L  S  R  L  Q  *  *  Y  L
       - E  *  H  Y  R  N  L  L  T  *  N  *  A  D  C  N  D  D  T  *
       -  N  N  I  T  A  I  S  *  H  R  I  K  Q  I  A  M  M  I  P  K
7021 - AAGACACTTCCAAGAAAAGGAACGTCGTAAACAAATTCACCTAATCTGAGGGAACTAAGA - 7080
       - K  T  L  P  R  K  G  T  S  *  T  N  S  P  N  L  R  E  L  R
       - R  H  F  Q  E  K  E  R  R  K  Q  I  H  L  I  *  G  N  *  E
       -  D  T  S  K  K  R  N  V  V  N  K  F  T  *  S  E  G  T  K  N
7081 - ATAGGTCGAGAACTTTGGTAAGTCCACTGCTAAAGTAGCATGTTCGATCTGAACTGTTAA - 7140
       - I  G  R  E  L  W  *  V  H  C  *  S  S  M  F  D  L  N  C  *
       - *  V  E  N  F  G  K  S  T  A  K  V  A  C  S  I  *  T  V  K
       -  R  S  R  T  L  V  S  P  L  L  K  *  H  V  R  S  E  L  L  K
7141 - AATCCAGACCGGCGACTCACCCAAAACCGTATATACAACAAGTGTTTTAAGAAAATAAAT - 7200
       - N  P  D  R  R  L  T  Q  N  R  I  Y  N  K  C  F  K  K  I  N
       - I  Q  T  G  D  S  P  K  T  V  Y  T  T  S  V  L  R  K  *  I
       -  S  R  P  A  T  H  P  K  P  Y  I  Q  Q  V  F  *  E  N  K  *
```

FIG. 5 Cont'd

```
7201 - AATCCAGAAAGTCGATATTACGTCCACAAGAAACCGATAAAACGATCAGTAAAGTAGTCG - 7260
     - N  P  E  S  R  Y  Y  V  H  K  K  P  I  K  R  S  V  K  *  S
     -  I  Q  K  V  D  I  T  S  T  R  N  R  *  N  D  Q  *  S  S  R
     -   S  R  K  S  I  L  R  P  Q  E  T  D  K  T  I  S  K  V  V  V
7261 - TTAAGAACCGAGTACACCAAATAGTAATCATAACATGTTTACCGTGGGCAAAGACGTTAC - 7320
     - L  R  T  E  Y  T  K  *  *  S  *  H  V  Y  R  G  Q  R  R  Y
     -  *  E  P  S  T  P  N  S  N  H  N  M  F  T  V  G  K  D  V  T
     -   K  N  R  V  H  Q  I  V  I  I  T  C  L  P  W  A  K  T  L  P
7321 - CAATCCTACATGTAGAAGAAACGAAGAAAGATGATGTATACCTTCTCGATACAAGTATAG - 7380
     - Q  S  Y  M  *  K  K  R  R  K  M  M  Y  T  F  S  I  Q  V  *
     -  N  P  T  C  R  R  N  E  E  R  *  C  I  P  S  R  Y  K  Y  S
     -   I  L  H  V  E  E  T  K  K  D  D  V  Y  L  L  D  T  S  I  V
7381 - TACCTACCAACGTGGAGAAGCTGAACGTACTACACGATATTCGCGTTAGCACGGTGTGCG - 7440
     - Y  L  P  T  W  R  S  *  T  Y  Y  T  I  F  A  L  A  R  C  A
     -  T  Y  Q  R  G  E  A  E  R  T  T  R  Y  S  R  *  H  G  V  R
     -   P  T  N  V  E  K  L  N  V  L  H  D  I  R  V  S  T  V  C  A
7441 - CAACTCACATGTTGATAACAATTACCGTACTTCTCTAGAAAGATACAGATACGTTTACCT - 7500
     - Q  L  T  C  *  *  Q  L  P  Y  F  S  R  K  I  Q  I  R  L  P
     -  N  S  H  V  D  N  N  Y  R  T  S  L  E  R  Y  R  Y  V  Y  L
     -   T  H  M  L  I  T  I  T  V  L  L  *  K  D  T  D  T  F  T  S
7501 - CCGGCACCGAAGACGTTCTGAGTGTTAACCTTAACAGAGTTAACACTGTGTAAAACGTGA - 7560
     - P  A  P  K  T  F  *  V  L  T  L  T  E  L  T  L  C  K  T  *
     -  R  H  R  R  R  S  E  C  *  P  *  Q  S  *  H  C  V  K  R  D
     -   G  T  E  D  V  L  S  V  N  L  N  R  V  N  T  V  *  N  V  T
7561 - CCATCATGTAAGTAATCACTACTTCAACGAGCACTAAACAGTGAGGTCAAATTTTCTGGT - 7620
     - P  S  C  K  *  S  L  L  Q  R  A  L  N  S  E  V  K  F  S  G
     -  H  H  V  S  N  H  Y  F  N  E  H  *  T  V  R  S  N  F  L  V
     -   I  M  *  V  I  T  T  S  T  S  T  K  Q  *  G  Q  I  F  W  L
7621 - TAGTTGGGATGACTGGTCAGTAGCATATAACAACTATCACAACGACACTTTTTACCGCGC - 7680
     - *  L  G  *  L  V  S  S  I  *  Q  L  S  Q  R  H  F  L  P  R
     -  S  W  D  D  W  S  V  A  Y  N  N  Y  H  N  D  T  F  Y  R  A
     -   V  G  M  T  G  Q  *  H  I  T  T  I  T  T  T  L  P  T  A  R
7681 - GAAGTGGAGATGAAACTGTTCCGACCAGTTTTCTGGATACTCTCTGTAGGAGAGAGGGTA - 7740
     - E  V  E  M  K  L  F  R  P  V  F  W  I  L  S  V  G  E  R  V
     -  K  W  R  *  N  C  S  D  Q  F  S  G  Y  S  L  *  E  R  G  *
     -   S  G  D  E  T  V  P  T  S  F  L  D  T  L  C  R  R  E  G  K
7741 - AAACAGTTAAATCTGTTAAACTCTCGATTGTTGTGATTTCCAAGTGACGGATAATTACAG - 7800
     - K  Q  L  N  L  L  N  S  R  L  L  *  F  P  S  D  G  *  L  Q
     -  N  S  *  I  C  *  T  L  D  C  C  D  F  Q  V  T  D  N  Y  S
     -   T  V  K  S  V  K  L  S  I  V  V  I  S  K  *  R  I  I  T  V
7801 - TATCAAAAACTACCGTTCAGGTTTACGCTGCTCAGACGAAGATTCAGACGAAGACACATG - 7860
     - Y  Q  K  L  P  F  R  F  T  L  L  R  R  R  F  R  R  R  H  M
     -  I  K  N  Y  R  S  G  L  R  C  S  D  E  D  S  D  E  D  T  *
     -   S  K  T  T  V  Q  V  Y  A  A  Q  T  K  I  Q  T  K  T  H  D
7861 - ATGTCAGTCGACTACACGGTTGGATAAGACAACGAACTGGTTCGAGAACATAGTCTGCAA - 7920
     - M  S  V  D  Y  T  V  G  *  D  N  E  L  V  R  E  H  S  L  Q
     -  C  Q  S  T  T  R  L  D  K  T  T  N  W  F  E  N  I  V  C  N
     -   V  S  R  L  H  G  W  I  R  Q  R  T  G  S  R  T  *  S  A  T
7921 - CCTCTATCATGACTTCAAAGGCAATTCTACAAACTACGAATACAGCTGTGGAAAAGTCGT - 7980
     - P  L  S  *  L  Q  R  Q  F  Y  K  L  R  I  Q  L  W  K  S  R
     -  L  Y  H  D  F  K  G  N  S  T  N  Y  E  Y  S  C  G  K  V  V
     -   S  I  M  T  S  K  A  I  L  Q  T  T  N  T  A  V  E  K  S  L
7981 - TGAAAATCACAAGGATACCTTTTTGAATTCCGTGAACAACGATGTCGAGTGTCGCTCAAT - 8040
     - *  K  S  Q  G  Y  L  F  E  F  R  E  Q  R  C  R  V  S  L  N
     -  E  N  H  K  D  T  F  L  N  S  V  N  N  D  V  E  C  R  S  I
     -   K  I  T  R  I  P  F  *  I  P  *  T  T  M  S  S  V  A  Q  S
8041 - CGTTTCCCACATCGAAATCTACCACAGGAAAGATGTAAGCACAGTCGACGGGCTGTTCCA - 8100
     - R  F  P  H  R  N  L  P  Q  E  R  C  K  H  S  R  R  A  V  P
     -  V  S  H  I  E  I  Y  H  R  K  D  V  S  T  V  D  G  L  F  H
     -   F  P  T  S  K  S  T  T  G  K  M  *  A  Q  S  T  G  C  S  T
```

FIG. 5 Cont'd

```
8101 - CAACAACTATGGCTACAACTGTGTTTCCTACAATAACTTACAGAGTTTGAAAGTGTAGTG - 8160
     -  Q  Q  L  W  L  Q  L  C  F  L  Q  *  L  T  E  F  E  S  V  V
     -   N  N  Y  G  Y  N  C  V  S  Y  N  N  L  Q  S  L  K  V  *  *
     -    T  T  M  A  T  T  V  F  P  T  I  T  Y  R  V  *  K  C  S  E
8161 - AGACTGAATCTTCACTGTCCACTGTCAACATTGTTAAAGTACGAGTGGATATTATTCCAA - 8220
     -  R  L  N  L  H  C  P  L  S  T  L  L  K  Y  E  W  I  L  F  Q
     -   D  *  I  F  T  V  H  C  Q  H  C  *  S  T  S  G  Y  Y  S  N
     -    T  E  S  S  L  S  T  V  N  I  V  K  V  R  V  D  I  I  P  T
8221 - CTTTTGTACTGCGGGTCTCTAGAACCGCGTACATAACTGACATTACGTTCCGTATAGTTA - 8280
     -  L  L  Y  C  G  S  L  E  P  R  T  *  L  T  L  R  S  V  *  L
     -   F  C  T  A  G  L  *  N  R  V  H  N  *  H  Y  V  P  Y  S  Y
     -    F  V  L  R  V  S  R  T  A  Y  I  T  D  I  T  F  R  I  V  T
8281 - CGGGTTCATCGTTTTTCAGTGTTACAAAGTGAGTAGACCTTACATTTCTGATGTACAGA - 8340
     -  R  V  H  R  F  S  V  L  Q  S  E  *  T  L  H  F  L  M  Y  R
     -   G  F  I  V  F  Q  C  Y  K  V  S  R  P  Y  I  F  *  C  T  E
     -    G  S  S  F  F  S  V  T  K  *  V  D  L  T  F  S  D  V  Q  K
8341 - AATAGACTTGTCGACGCATTTGTTTAAGCATCACGACGGTTCTTCTTGTTGTATGGAAAA - 8400
     -  N  R  L  V  D  A  F  V  *  A  S  R  R  F  L  L  Y  G  K
     -   I  D  L  S  T  H  L  F  K  H  H  D  G  S  S  C  C  M  E  N
     -    *  T  C  R  R  I  C  L  S  I  T  T  V  L  L  V  V  W  K  I
8401 - TCTGATTGAACACGATGTTGATCTGTCCAACAGTTACAGTATTGATGATTTTAGAGTGAG - 8460
     -  S  D  *  T  R  C  *  S  V  Q  Q  L  Q  Y  *  *  F  *  S  E
     -   L  I  E  H  D  V  D  L  S  N  S  Y  S  I  D  D  F  R  V  S
     -    *  L  N  T  M  L  I  C  P  T  V  T  V  L  M  I  L  E  *  V
8461 - TTCCCACCATTCTAACAATCATGAACAAAATTTGAATACGAATTCCGGTGTAATAACACG - 8520
     -  F  P  P  F  *  Q  S  *  T  K  F  E  Y  E  F  R  C  N  N  T
     -   S  H  H  S  N  N  H  E  Q  N  L  N  T  N  S  G  V  I  T  R
     -    P  T  I  L  T  I  M  N  K  I  *  I  R  I  P  V  *  *  H  A
8521 - CAAGAACGACGTAACCAAACAATATAGCAATACGGTCATGTATGTAACAGTTAGGTACTA - 8580
     -  Q  E  R  R  N  Q  T  I  *  Q  Y  G  H  V  C  N  S  *  V  L
     -   K  N  D  V  T  K  Q  Y  S  N  T  V  M  Y  V  T  V  R  Y  Y
     -    R  T  T  *  P  N  N  I  A  I  R  S  C  M  *  Q  L  G  T  T
8581 - CCAATGTGTTTACTTTAGTAACCAATGTTTCGGTAAGTCCTACCACAGTGAGCACTGTAG - 8640
     -  P  M  C  L  L  *  *  P  M  F  R  *  V  L  P  Q  *  A  L  *
     -   Q  C  V  Y  F  S  N  Q  C  F  G  K  S  Y  H  S  E  H  C  S
     -    N  V  F  T  L  V  T  N  V  S  V  S  P  T  T  V  S  T  V  V
8641 - TAAAGATGACTACTAACAAAACGTTTATTTGTACGACCAAAACTGCGTACCAAATCGGTC - 8700
     -  *  R  *  L  L  T  K  R  L  F  V  R  P  K  L  R  T  K  S  V
     -   K  D  D  Y  *  Q  N  V  Y  L  Y  D  Q  N  C  V  P  N  R  S
     -    K  M  T  T  N  K  T  F  I  C  T  T  K  T  A  Y  Q  I  G  R
8701 - GCACCACCAAGTATGTTTTTACTGTTTTCGACGGGACATCATCGACGATAGTAATGTTCT - 8760
     -  A  P  P  S  M  F  L  L  F  S  T  G  H  H  R  R  *  *  C  S
     -   H  H  Q  V  C  F  Y  C  F  R  R  D  I  I  D  D  S  N  V  L
     -    T  T  K  Y  V  F  T  V  F  D  G  T  S  S  T  I  V  M  F  S
8761 - CTCTAACCAAAGTATCACGGACCGAATGGCCCATGACACGACTCTCGTTAGTTACCACTG - 8820
     -  L  *  P  K  Y  H  G  P  N  G  P  *  H  D  S  R  *  L  P  L
     -   S  N  Q  S  I  T  D  R  M  A  H  D  T  T  L  V  S  Y  H  *
     -    L  T  K  V  S  R  T  E  W  P  M  T  R  L  S  L  V  T  T  E
8821 - AAGAACGTAAAAGATGGAGCACAAAAATCACGACAACCGTTGTAAACGATGTGTGGAAGG - 8880
     -  K  N  V  K  D  G  A  Q  K  S  R  Q  P  L  *  T  M  C  G  R
     -   R  T  *  K  M  E  H  K  N  H  D  N  R  C  K  R  C  V  E  G
     -    E  R  K  W  S  T  K  I  T  T  T  V  V  N  D  V  W  K  V
8881 - TTTGAGTAACTCATATCACTAAAACGATGGAGACGAACGCAAGAACGACGACTCACATGT - 8940
     -  F  E  *  L  I  S  L  K  R  W  R  R  T  Q  E  R  R  L  T  C
     -   L  S  N  S  Y  H  *  N  D  G  D  E  R  K  N  D  D  S  H  V
     -    *  V  T  H  I  T  K  T  M  E  T  N  A  R  T  T  T  H  M  L
8941 - TAAAAATTCCTACGATACCCGTTTGGACACGGTATAACAATACTGTGATTAAACGATCTC - 9000
     -  *  K  F  L  R  Y  P  F  G  H  G  I  T  I  L  *  L  N  D  L
     -   K  N  S  Y  D  T  R  L  D  T  V  *  Q  Y  C  D  *  T  I  S
     -    K  I  P  T  I  P  V  W  T  R  Y  N  N  T  V  I  K  R  S  P
```

FIG. 5 Cont'd

```
9001 - CCAAGATAAAGAATATCACTCGAAGCAGGTCTGTGAGCAATACACGAATACCTACCAAGG - 9060
     -   P R * R I S L E A G L * A I H E Y L P R
     - Q D K E Y H S K Q V C E Q Y T N T Y Q G
     -  K I K N I T R S R S V S N T R I P T K V
9061 - TAGTATGTCAAAGGATTGTGAATGGACCTCCCAAGACAATCTCATCATTGTTGAAAACTA - 9120
     -  * Y V K G L * M D L P R Q S H H C * K L
     -  S M S K D C E W T S Q D N L I I V E N Y
     - V C Q R I V N G P P P K T I S S L L K T T
9121 - CGACTCATGACATCTGTACCATGTACGCTTTCCAGTCTTCATCCATAAACGGATAGATGG - 9180
     - R L M T S V P C T L S S L H P * T D R W
     - D S * H L Y H V R F P V F I H K R I D G
     -  T H D I C T M Y A F Q S S S I N G * M V
9181 - TCACCATCTACCCAAGAATTATTACTCGTAATGTCTCGAGATAGTCCTCAAAAGACACCA - 9240
     - S P S T Q E L L L V M S R D S P Q K T P
     -  H H L P K N Y Y S * C L E I V L K R H H
     -   T I Y P R I I T R N V S R * S S K D T T
9241 - CAACTACGCTACTTAGAGTATCGATTGTAGAAATGAGGAGAACACGTTGGACACCCACGA - 9300
     - Q L R Y L E Y R L * K * G E H V G H P R
     -  N Y A T * S I D C R N E E N T L D T H E
     -   T T L L R V S I V E M R R T R W T P T K
9301 - AATCTACACGACGAAGTCATCACCGACCACCATAATAACGGTATAACCACTGAACACGA - 9360
     - N L H R R S H H R P P * * R Y N H * T R
     -  I Y T D E V I T D H H N G I T T E H D
     -   S T Q T K S S P T T I I T V * P L N T T
9361 - CGGATGATGAAATACTTTAAGTCTGCACGAAAACCACTCATGTTGGTACAACAACGACGA - 9420
     - R M M K Y F K S A R K P L M L V Q Q R R
     -  G * * N T L S L H E N H S C W Y N N D D
     -   D D E I L * V C T K T T H V G T T T T I
9421 - TTACGTGAAAACAAAAACTACAGAAAGTGATATGAGACAGACCGTGGTCGAATGTCGAAA - 9480
     - L R E N K N Y R K * Y E T D R G R M S K
     -  Y V K T K T T E S D M R Q T V V E C R K
     -   T * K Q K L Q K V I * D R P W S N V E R
9481 - GACGGCCCTCAGATGAGTCAGAAAATGAACATGAACTGTAAGATAAAGTGGTTACTACAA - 9540
     - D G P Q M S Q K M N M N C K I K W L L Q
     -  T A L R * V R K * T * T V R * S G Y Y K
     -   R P S D E S E N E H E L * D K V V T T K
9541 - AGTAAGAACCGAGTGGAAGTTACCAAACGGTACAAAAGAGGATAACACGGAAAAACCTAT - 9600
     - S K N R V E V T K R Y K R G * H G K T Y
     -  V R T E W K L P N G T K E D N T E K P I
     -   * E P S G S Y Q T V Q K R I T R K N L L
9601 - TGTCGTTAGATACATAAGACATAAAGAGACTTCGTGACGGTAACCAAGAAATTGTTGATA - 9660
     - C R * I H K T * R D F V T V T K K L L I
     -  V V R Y I R H K E T S * R * P R N C * *
     -   S L D T * D I K R L R D G N Q E I V D R
9661 - GAATCCTTTTCTCAGTACAAATTACCTCAATGTAAATCATGGAAGCTCCTCCGACGAAAC - 9720
     - E S F S Q Y K L P Q C K S W K L L R R N
     -  N P F L S T N Y L N V N H G S S S D E T
     -   I L F S V Q I T S M * I M E A P P T K H
9721 - ACATGGAAAAACGAGTTGTTCCTTTACATGGATTTTAACGCATCGCTCTGTGACAACGGT - 9780
     - T W K N E L F L Y M D F N A S L C D N G
     -  H G K T S C S F T W I L T H R S V T T V
     -   M E K R V V P L H G F * R I A L * Q R *
9781 - GAATGTGTCATATTGTCCATAGAACGAGATATATTGTTCATGTTCATAAAGTCACCTCGG - 9840
     - E C V I L S I E R D I L F M F I K S P R
     -  N V S Y C P * N E I Y C S C S * S H L G
     -   M C H I V H R T R Y I V H V H K V T S E
9841 - AATCTATGATGGTCGATAGCACTTCGTCGAACGACGGTGAATCGTTTCCGAGATTTACTG - 9900
     - N L * W S I A L R R T T V N R F R D L L
     -  I Y D G R * H F V E R R * I V S E I Y *
     -   S M M V D S T S S N D G E S F P R F T E
```

FIG. 5 Cont'd

```
9901  - AAATCGTTGAGTCCACGACTACAAGAGATGGTTGGTGGTGTCTGTAGTTAGTGAAGACGA - 9960
      - K  S  L  S  P  R  L  Q  E  M  V  G  G  V  C  S  *  *  R  R
      -  N  R  *  V  H  D  Y  K  R  W  L  V  V  S  V  V  S  E  D  D
      -   I  V  E  S  T  T  T  R  D  G  W  W  C  L  *  L  V  K  T  T
9961  - CAAGACGTCTCACCAAAATCCTTTTACCGTAAGGGCAGTCCGTTTCAACTTCCCACGTAC - 10020
      - Q  D  V  S  P  K  S  F  Y  R  K  G  S  P  F  Q  L  P  T  Y
      -  K  T  S  H  Q  N  P  F  T  V  R  A  V  R  F  N  F  P  R  T
      -   R  R  L  T  K  I  L  L  P  *  G  Q  S  V  S  T  S  H  V  P
10021 - CATGTTCATTGGACACCTTGATGTTGAGAATTACCTAACACCAACCTACTGTGTCATATG - 10080
      - H  V  H  W  T  P  *  C  *  E  L  P  N  T  N  L  L  C  H  M
      -  M  F  I  G  H  L  D  V  E  N  Y  L  T  P  T  Y  C  V  I  *
      -   C  S  L  D  T  L  M  L  R  I  T  *  H  Q  P  T  V  S  Y  D
10081 - ACAGGTTCTGTACAGTAAACGTGTCGTCTTCTGTACGAATTAGGATTGATACTTCTAGAC - 10140
      - T  G  S  V  Q  *  T  C  R  L  L  Y  E  L  G  L  I  L  L  D
      -  Q  V  L  Y  S  K  R  V  V  F  C  T  N  *  D  *  Y  F  *  T
      -   R  F  C  T  V  N  V  S  S  S  V  R  I  R  I  D  T  S  R  R
10141 - GAGTAAGCGTTTAGGTTGGTATCGAAAGAACAAGTCCGACCGTTACAAGTTGAAGCACAA - 10200
      - E  *  A  F  R  L  V  S  K  E  Q  V  R  P  L  Q  V  E  A  Q
      -  S  K  R  L  G  W  Y  R  K  N  K  S  D  R  Y  K  L  K  H  N
      -   V  S  V  *  V  G  I  E  R  T  S  P  T  V  T  S  *  S  T  I
10201 - TAACCGGTAAGATACGTTTTAACAGACGAATCCGAATTTCAACTATGAAGATTGGGATTC - 10260
      - *  P  V  R  Y  V  L  T  D  E  S  E  F  Q  L  *  R  L  G  F
      -  N  R  *  D  T  F  *  Q  T  N  P  N  F  N  Y  E  D  W  D  S
      -   T  G  K  I  R  F  N  R  R  I  R  I  S  T  M  K  I  G  I  L
10261 - TGTGGGTTCATATTTAAACAGGCATAGGTTGGACCAGTTTGTAAAAGTCAAGATCGTACG - 10320
      - C  G  F  I  F  K  Q  A  *  V  G  P  V  C  K  S  Q  D  R  T
      -  V  G  S  Y  L  N  R  H  R  L  D  Q  F  V  K  V  K  I  V  R
      -   W  V  H  I  *  T  G  I  G  W  T  S  L  *  K  S  R  S  Y  D
10321 - ATGTTACCAAGTGGTAGACCACAAATAGTCACACGGTACTCTGGATTAGTATGGTAATTT - 10380
      - M  L  P  S  G  R  P  Q  I  V  T  R  Y  S  G  L  V  W  *  F
      -  C  Y  Q  V  V  D  H  K  *  S  H  G  T  L  D  *  Y  G  N  F
      -   V  T  K  W  *  T  T  N  S  H  T  V  L  W  I  S  M  V  I  S
10381 - CCAAGAAAGGAATTACCTAGTACACCATCACAACCAAAATTGTAACTAATACTAACGCAC - 10440
      - P  R  K  E  L  P  S  T  P  S  Q  P  K  L  *  L  I  L  T  H
      -  Q  E  R  N  Y  L  V  H  H  H  N  Q  N  C  N  *  Y  *  R  T
      -   K  K  G  I  T  *  Y  T  I  T  T  K  I  V  T  N  T  N  A  Q
10441 - AGAAAGACGATATACGTAGTATACCTCGAAGGTTGTCCTCATGTGCGACCATGACTGAAT - 10500
      - R  K  T  I  Y  V  V  Y  L  E  G  C  P  H  V  R  P  *  L  N
      -  E  R  R  Y  T  *  Y  T  S  K  V  V  L  M  C  D  H  D  *  I
      -   K  D  D  I  R  S  I  P  R  R  L  S  S  C  A  T  M  T  E  S
10501 - CTTCCATTTAAGATACCAGGTAAACAACTGTCTGTTTGACGTGTCCGACGTCCATGTCTG - 10560
      - L  P  F  K  I  P  G  K  Q  L  S  V  *  R  V  R  R  P  C  L
      -  F  H  L  R  Y  Q  V  N  N  C  L  F  D  V  S  D  V  H  V  C
      -   S  I  *  D  T  R  *  T  T  V  C  L  T  C  P  T  S  M  S  V
10561 - TGTTGGTATTGTAATTTACAAAACCGTACCGACATACGACGACAATAGTTACCACTATCC - 10620
      - C  W  Y  C  N  L  Q  N  R  T  D  I  R  R  Q  *  L  P  L  S
      -  V  G  I  V  I  Y  K  T  V  P  T  Y  D  D  N  S  Y  H  Y  P
      -   L  V  L  *  F  T  K  P  Y  R  H  T  T  T  I  V  T  T  I  H
10621 - ACCAAAGAATTATCTAAGTGGTGATGAAACTTACTGAAATTGGAACACCGTTACTTCATG - 10680
      - T  K  E  L  S  K  W  *  *  N  L  L  K  L  E  H  R  Y  F  M
      -  P  K  N  Y  L  S  G  D  E  T  Y  *  N  W  N  T  V  T  S  C
      -   Q  R  I  I  *  V  V  M  K  L  T  E  I  G  T  P  L  L  H  V
10681 - TTGATACTTGGAAACTGTGTTCTAGTACAACTGTATAACCCTGGAGAAAGACGAGTTTGT - 10740
      - L  I  L  G  N  C  V  L  V  Q  L  Y  N  P  G  E  R  R  V  C
      -  *  Y  L  E  T  V  F  *  Y  N  C  I  T  L  E  K  D  E  F  V
      -   D  T  W  K  L  C  S  S  T  T  V  *  P  W  R  K  T  S  L  S
10741 - CCTTAACGGCAGAATCTATACACACGACGAAACTTTCTCGACGACGTCTTACCATACTTA - 10800
      - P  *  R  Q  N  L  Y  T  R  R  N  F  L  D  D  V  L  P  Y  L
      -  L  N  G  R  I  Y  T  H  D  E  T  F  S  T  T  S  Y  H  T  Y
      -   L  T  A  E  S  I  H  T  T  K  L  S  R  R  R  L  T  I  L  T
```

FIG. 5 Cont'd

```
10801 - CCAGCATGATAGGAACCATCGTGATAAAATCTTCTACTCAAATGTGGTAAACTACAACAA - 10860
       - P  A  *  *  E  P  S  *  *  N  L  L  L  K  C  G  K  L  Q  Q
       - Q  H  D  R  N  H  R  D  K  I  F  Y  S  N  V  V  N  Y  N  N
       -    S  M  I  G  T  I  V  I  K  S  S  T  Q  M  W  *  T  T  T  I
10861 - TCTGTTACGAGACCACAATGGAAGGTTCCATTCAAGTTCTTTTAACAATTCCCGTGAGTA - 10920
       - S  V  T  R  P  Q  W  K  V  P  F  K  F  F  *  Q  F  P  *  V
       - L  L  R  D  H  N  G  R  F  H  S  S  S  F  N  N  S  R  E  *
       -    C  Y  E  T  T  M  E  G  S  I  Q  V  L  L  T  I  P  V  S  S
10921 - GTAACCTACGAAAATTGAAAGAACTGTAGTGATAACTAAGAACAAGTTTCATGTGTCACC - 10980
       - V  T  Y  E  N  *  K  N  C  S  D  N  *  E  Q  V  S  C  V  T
       - *  P  T  K  I  E  R  T  V  V  I  T  K  N  K  F  H  V  S  P
       -    N  L  R  K  L  K  E  L  *  *  *  L  R  T  S  F  M  C  H  Q
10981 - AGTGACAAAAAGAAACAAATGCTCTTACGAAAGAACGGTAAATGAGAACCATAATACCGT - 11040
       - S  D  K  K  K  Q  M  L  L  R  K  N  G  K  *  E  P  *  Y  R
       - V  T  K  R  N  K  C  S  Y  E  R  T  V  N  E  N  H  N  T  V
       -    *  Q  K  E  T  N  A  L  T  K  E  R  *  M  R  T  I  I  P  L
11041 - TAACGACGTACACGATACGACGAACAATTCGTATTCGTGCGTAAGAACACGAACAAAGAC - 11100
       - *  R  R  T  R  Y  D  E  Q  F  V  F  V  R  K  N  T  N  K  D
       - N  D  V  H  D  T  T  N  N  S  Y  S  C  V  R  T  R  T  K  T
       -    T  T  Y  T  I  R  R  T  I  R  I  R  A  *  E  H  E  Q  R  Q
11101 - AATGGAAGAGAACGTTGTCAACGAATGAAATTATACCAGATGTACGGACGATCGACCCAC - 11160
       - N  G  R  E  R  C  Q  R  M  K  L  Y  Q  M  Y  G  R  S  T  H
       - M  E  E  N  V  V  N  E  *  N  Y  T  R  C  T  D  D  R  P  T
       -    W  K  R  T  L  S  T  N  E  I  I  P  D  V  R  T  I  D  P  L
11161 - TACGCATAGTACTGTACCGAACTTAACCGACTGTGATCGAACAGACCAATATCCGAATTC - 11220
       - Y  A  *  Y  C  T  E  L  N  R  L  *  S  N  R  P  I  S  E  F
       - T  H  S  T  V  P  N  L  T  D  C  D  R  T  D  Q  Y  P  N  S
       -    R  I  V  L  Y  R  T  *  P  T  V  I  E  Q  T  N  I  R  I  P
11221 - CTAACACAATACATACGAAGTCGAAATCAAAACGAATAAGAGTACTGTCGAGCGTGACAA - 11280
       - L  T  Q  Y  I  R  S  R  N  Q  N  E  *  E  Y  C  R  A  *  Q
       - *  H  N  T  Y  E  V  E  I  K  T  N  K  S  T  V  E  R  D  K
       -    N  T  I  H  T  K  S  K  S  K  R  I  R  V  L  S  S  V  T  N
11281 - ATACTACTACGACGATCTGCACAAACCTGTGACTACTTACAGTAATGTGAACAAATGTTT - 11340
       - I  L  L  R  R  S  A  Q  T  C  D  Y  L  Q  *  C  E  Q  M  F
       - Y  Y  Y  D  D  L  H  K  P  V  T  T  Y  S  N  V  N  K  C  F
       -    T  T  T  T  I  C  T  N  L  *  L  L  T  V  M  *  T  N  V  S
11341 - CAGATGATACCATTACGAAATCTAGTTCGATAAAGGTACACCCGGAATCAATAAAGACAT - 11400
       - Q  M  I  P  L  R  N  L  V  R  *  R  Y  T  R  N  Q  *  R  H
       - R  *  Y  H  Y  E  I  *  F  D  K  G  T  P  G  I  N  K  D  I
       -    D  D  T  I  T  K  S  S  S  I  K  V  H  P  E  S  I  K  T  L
11401 - TGGAGATTGATAAGACCACAGCAATGCTGATAGTACAAAAATCGATCTCGATATCACAAA - 11460
       - W  R  L  I  R  P  Q  Q  C  *  *  Y  K  N  R  S  R  Y  H  K
       - G  D  *  *  D  H  S  N  A  D  S  T  K  I  D  L  D  I  T  N
       -    E  I  D  K  T  T  A  M  L  I  V  Q  K  S  I  S  I  S  Q  T
11461 - CACACACAACTCATAATGGGTAACAATAAATAATGACCGTTGTGGAATGTCACATAGTAC - 11520
       - H  T  Q  L  I  M  G  N  N  K  *  *  P  L  W  N  V  T  *  Y
       - T  H  N  S  *  W  V  T  I  N  N  D  R  C  G  M  S  H  S  T
       -    H  T  T  H  N  G  *  Q  *  I  M  T  V  V  E  C  H  I  V  R
11521 - GAACAAATAACAAAGAATCCGATAACAACGACGACGATGAAACCGGAAAAGACAAATGAG - 11580
       - E  Q  I  T  K  N  P  I  T  T  T  T  M  K  P  E  K  T  N  E
       - N  K  *  Q  R  I  R  *  Q  R  R  R  *  N  R  K  R  Q  M  S
       -    T  N  N  K  E  S  D  N  N  D  D  D  E  T  G  K  D  K  *  V
11581 - TTGGCAATGAAGTCCGAATGAGAACCACAAATACTGATGAACCAGAGATGTGTTCTTAAA - 11640
       - L  A  M  K  S  E  *  E  P  Q  I  L  M  N  Q  R  C  V  L  K
       - W  Q  *  S  P  N  E  N  H  K  Y  *  *  T  R  D  V  F  L  N
       -    G  N  E  V  R  M  R  T  T  N  T  D  E  P  E  M  C  S  *  I
11641 - TCCATATACTTGAGGGTCCCCGAAAACGGAGGATTCTCATCATAACTACGAAAGTTCGAA - 11700
       - S  I  Y  L  R  V  P  E  N  G  G  F  S  S  *  L  R  K  F  E
       - P  Y  T  *  G  S  P  K  T  E  D  S  H  H  N  Y  E  S  S  N
       -    H  I  L  E  G  P  R  K  R  R  I  L  I  I  T  T  K  V  R  I
```

FIG. 5 Cont'd

```
11701 - TTGTAATTCAACAACCCATAACCTCCATTTGGTACATAGTTCCAACGATGACATGTCAGA - 11760
       - L * F N N P * P P F G T * F Q R * H V R
       - C N S T T H N L H L V H S S N D D M S D
       - V I Q Q P I T S I W Y I V P T M T C Q I
11761 - TTTTACAGACTGCATTTCACGTGTAGACACCATGACGAGAGCCAAGAAGTTGTTGAATCT - 11820
       - F Y R L H F T C R H H D E S Q E V V E S
       - F T D C I S R V D T M T R A K K L L N L
       - L Q T A F H V * T P * R E P R S C * I S
11821 - CATCTCAGTAGAAGATTTAACACCCGTGTTACACATGTGAGGTGTTACTATAAGAAGAA - 11880
       - H L S R R F N T R V T H V E V L L * E E
       - I S V E D L T P V L H M L R C Y Y K K N
       - S Q * K I * H P C Y T C * G V T I R R T
11881 - CGTTTTCTGTGTTGACTTCGAAAGCTCTTCTACCAAAGAGAAAACAGACAAAACGATAGG - 11940
       - R F L C * L R K L F Y Q R E N R Q N D R
       - V F C V D F E S S S T K E K T D K T I G
       - F S V L T S K A L L P K R K Q T K R * V
11941 - TACGTCCCACGACATCTGTAATTATCCAACACGCTCCTTTACGAGCTATTGGCACGATGA - 12000
       - Y V P R H L * L S N T L L Y E L L A R *
       - T S H D I C N Y P T R S F T S Y W H D E
       - R P T T S V I I Q H A P L R A I G T M R
12001 - GAAGTCCGATAACGAAGTCTTAAATCAAGAAATGGTAGTATACGGCGAATACGGTGACGG - 12060
       - E V R * R S L K S R N G S I R R I R * R
       - K S D N E V L N Q E M V V Y G E Y G D G
       - S P I T K S * I K K W * Y T A N T V T G
12061 - GTCCTCCGGATACTCGTCCGACATCGATTACCACTAAGACTTCAGCAAGAGTTTTTCAAT - 12120
       - V L R I L V R H R L P L R L Q Q E F F N
       - S S G Y S S D I D Y H * D F S K S F S I
       - P P D T R P T S I T T K T S A R V F Q F
12121 - TTCTTTAGAAACTTACACCGATTTAGACTCAAACTGGCACTACGACGGTACGTTGCGTTC - 12180
       - F F R N L H R F R L K L A L R R Y V A F
       - S L E T Y T D L D S N W H Y D G T L R S
       - L * K L T P I * T Q T G T T T V R C V Q
12181 - AACCTTTTCTACCGTCTAGTCCGATACTGGGTTTACATGTTTGTCCGTTCTAGACTCCTG - 12240
       - N L F Y R L V R Y W V Y M F V R S R L L
       - T F S T V * S D T G F T C L S V L D S C
       - P F L P S S P I L G L H V C P F * T P V
12241 - TTCTCCCGTTTTCATTGATCACGATACGTTTGTTACGAGAAGTGATACGAATCCTTCGAA - 12300
       - F S R F H * S R Y V C Y E K * Y E S F E
       - S P V F I D H D T F V T R S D T N P S N
       - L P F S L I T I R L L R E V I R I L R T
12301 - CTATTACTACGTGAATTGTTGTAATAGTTGTTACGCGCACTACCAACACAAGGTGAGTTG - 12360
       - L L L R E L L * * L L R A L P T Q G E L
       - Y Y Y V N C C N S C Y A H Y Q H K V S C
       - I T T * I V V I V V T R T T N T R * V V
12361 - TAGTATGGTAACTGATGTCGTCGGTTTGAGTACCAACAACAGGGACTAATACCATGGATG - 12420
       - * Y G N * C R R F E Y Q Q Q G L I P W M
       - S M V T D V V G L S T N N R D * Y H G C
       - V W * L M S S V * V P T T G T N T M D V
12421 - TTCTTGTGAACACTACCATTGTGGAAATGTATACGTAGACGTGAGACCCTTTAGGTCGTT - 12480
       - F L * T L P L W K C I R R R E T L * V V
       - S C E H Y H C G N V Y V D V R P F R S F
       - L V N T T I V E M Y T * T * D P L G R S
12481 - CAACAACTACGCCTATCGTTCTAACAAGTTGAATCACTTTAATTGTACCTGTTAAGTGGT - 12540
       - Q Q L R L S F * Q V E S L * L Y L L S G
       - N N Y A Y R S N K L N H F N C T C * V V
       - T T T P I V L T S * I T L I V P V K W F
12541 - TTAAACCGAACCGGAGAATAACAATGTCGAGATTCTCGGTTGAGTCGACAATTTGATGTC - 12600
       - L N R T G E * Q C R D S R L S R Q F D V
       - * T E P E N N N V E I L G * V D N L M S
       - K P N R R I T M S R F S V E S T I * C L
```

FIG. 5 Cont'd

```
12601 - TTATTACTTGACTCAGGTCATCGTGATGCTGTCTACAGGACACGCCGACCATGGTGTGTT - 12660
      - L  L  L  D  S  G  H  R  D  A  V  Y  R  T  R  R  P  W  C  V
      -  Y  Y  L  T  Q  V  I  V  M  L  S  T  G  H  A  D  H  G  V  F
      -   I  T  *  L  R  S  S  *  C  C  L  Q  D  T  P  T  M  V  C  L
12661 - TGTCGAACATGACTACTGTTACGTGAACGGATGATATTGTTAAGCTTCCCTCCATCCAAA - 12720
      - C  R  T  *  L  L  L  R  E  R  M  I  L  L  S  F  P  P  S  K
      -  V  E  H  D  Y  C  Y  V  N  G  *  Y  C  *  A  S  L  H  P  N
      -   S  N  M  T  T  V  T  *  T  D  D  I  V  K  L  P  S  I  Q  T
12721 - CACGACCGTAATGATAGTCTGGTGGTTCTAGAGTTTACCCGATCTAAGGGATTCTCACTA - 12780
      - H  D  R  N  D  S  L  V  V  L  E  F  T  R  S  K  G  F  S  L
      -  T  T  V  M  I  V  W  W  F  *  S  L  P  D  L  R  D  S  H  Y
      -   R  P  *  *  *  S  G  G  S  R  V  Y  P  I  *  G  I  L  T  T
12781 - CCATGTCCATGTTAAATGTGTCTTGACCTTGGTGGAACATCCAAACAATGTCTGTGTGGT - 12840
      - P  C  P  C  *  M  C  L  D  L  G  G  T  S  K  Q  C  L  C  G
      -  H  V  H  V  K  C  V  L  T  L  V  E  H  P  N  N  V  C  V  V
      -   M  S  M  L  N  V  S  *  P  W  W  N  I  Q  T  M  S  V  W  F
12841 - TTTCCCGGATTTCACTTTATGAACATGAAGTAGTTTCCGAATTTGTTGGATTTATCTCCA - 12900
      - F  P  G  F  H  F  M  N  M  K  *  F  P  N  L  L  D  L  S  P
      -  F  P  D  F  T  L  *  T  *  S  S  F  R  I  C  W  I  Y  L  H
      -   S  R  I  S  L  Y  E  H  E  V  V  S  E  F  V  G  F  I  S  I
12901 - TACCACGACCCGTCAAATCGACGATGTCATGCAGAAGTCCGACCTTTACGATGTCTTCAT - 12960
      - Y  H  D  P  S  N  R  R  C  H  A  E  V  R  P  L  R  C  L  H
      -  T  T  T  R  Q  I  D  D  V  M  Q  K  S  D  L  Y  D  V  F  M
      -   P  R  P  V  K  S  T  M  S  C  R  S  P  T  F  T  M  S  S  W
12961 - GGACGGTTAAGTTGACACGAAAGGAAGACACGAAAACGTCATCTGGGACGATTTCGTATA - 13020
      - G  R  L  S  *  H  E  R  K  T  R  K  R  H  L  G  R  F  R  I
      -  D  G  *  V  D  T  K  G  R  H  E  N  V  I  W  D  D  F  V  Y
      -   T  V  K  L  T  R  K  E  D  T  K  T  S  S  G  T  I  S  Y  I
13021 - TTCCTAATGGATCGTTCACCTCCTGTTGGTTAGTGGTTGACACACTTCTACAACACATGT - 13080
      - F  L  M  D  R  S  P  P  V  G  *  W  L  T  H  F  Y  N  T  C
      -  S  *  W  I  V  H  L  L  L  V  S  G  *  H  T  S  T  T  H  V
      -   P  N  G  S  F  T  S  C  W  L  V  V  D  T  L  L  Q  H  M  C
13081 - GTGTGACCATGTCCTGTCCGTTAATGACATTGTGGTCTTCGATTGTACCTGGTTCTCAGG - 13140
      - V  *  P  C  P  V  R  *  *  H  C  G  L  R  L  Y  L  V  L  R
      -  C  D  H  V  L  S  V  N  D  I  V  V  F  D  C  T  W  F  S  G
      -   V  T  M  S  C  P  L  M  T  L  W  S  S  I  V  P  G  S  Q  E
13141 - AAACCACCACGAAGTACAACAGACATAACATCTACGGTGTAACTGGTAGGTTTAGGATTT - 13200
      - K  P  P  R  S  T  T  D  I  T  S  T  V  *  L  V  G  L  G  F
      -  N  H  H  E  V  Q  Q  T  *  H  L  R  C  N  W  *  V  *  D  F
      -   T  T  T  K  Y  N  R  H  N  I  Y  G  V  T  G  R  F  R  I  S
13201 - CCTAAGACACTGAACTTTCCATTCATGCAGGTTTATGGATGGTGAACACGATTACTGGGT - 13260
      - P  K  T  L  N  F  P  F  M  Q  V  Y  G  W  *  T  R  L  L  G
      -  L  R  H  *  T  F  H  S  C  R  F  M  D  G  E  H  D  Y  W  V
      -   *  D  T  E  L  S  I  H  A  G  L  W  M  V  N  T  I  T  G  S
13261 - CACCCAAAATGTGAATCTTTGTGTCAGACATGGCAGACGCCTTACACCTTTCCAATACCG - 13320
      - H  P  K  C  E  S  L  C  Q  T  W  Q  T  P  Y  T  F  P  I  P
      -  T  Q  N  V  N  L  C  V  R  H  G  R  R  L  T  P  F  Q  Y  R
      -   P  K  M  *  I  F  V  S  D  M  A  D  A  L  H  L  S  N  T  D
13321 - ACATCAACACTGGTTGAGGCGCTTGGGAACTACGTCAGACGCCTACGTAGTTGCAAAAAT - 13380
      - T  S  T  L  V  E  A  L  G  N  Y  V  R  R  L  R  S  C  K  N
      -  H  Q  H  W  L  R  R  L  G  T  T  S  D  A  Y  V  V  A  K  I
      -   I  N  T  G  *  G  A  W  E  L  R  Q  T  P  T  *  L  Q  K  F
13381 - TTGCCCAAACGCCACATTCACGTCGGGCAGAATGTGGCACGCCGTGTCCGTGATCATGAC - 13440
      - L  P  K  R  H  I  H  V  G  Q  N  V  A  R  R  V  R  D  H  D
      -  C  P  N  A  T  F  T  S  G  R  M  W  H  A  V  S  V  I  M  T
      -   A  Q  T  P  H  S  R  R  A  E  C  G  T  P  C  P  *  S  *  L
13441 - TACAGCAGATGTCCCGAAAACTATAAATGTTGCTTTTTCAACGACCAAAACGTTTCAAGG - 13500
      - Y  S  R  C  P  E  N  Y  K  C  C  F  F  N  D  Q  N  V  S  R
      -  T  A  D  V  P  K  T  I  N  V  A  F  S  T  T  K  T  F  Q  G
      -   Q  Q  M  S  R  K  L  *  M  L  L  F  Q  R  P  K  R  F  K  D
```

FIG. 5 Cont'd

```
13501 - ATTTTTGATTAACGACAGCGAAGGTCCTCTTCCTACTCCTTCCGTTAAATAATCTGAGAA - 13560
       - I  F  D  *  R  Q  R  R  S  S  S  Y  S  F  R  *  I  I  *  E
       - F  L  I  N  D  S  E  G  P  L  P  T  P  S  V  K  *  S  E  N
       - F  *  L  T  T  A  K  V  L  F  L  L  L  P  L  N  N  L  R  M
13561 - TGAAACATCAATTCTCCGTATGATACAGATTGATGGTTGTACTTCTCTGATAAATATTGA - 13620
       - *  N  I  N  S  P  Y  D  T  D  *  W  L  Y  F  S  D  K  Y  *
       - E  T  S  I  L  R  M  I  Q  I  D  G  C  T  S  L  I  N  I  E
       - K  H  Q  F  S  V  *  Y  R  L  M  V  V  L  L  *  *  I  L  N
13621 - ACCAATTTCTAACAGGTCGCCAACGACAGGTACTGAAAAAGTTCAAATCTCATCTACCAC - 13680
       - T  N  F  *  Q  V  A  N  D  R  Y  *  K  S  S  N  L  I  Y  H
       - P  I  S  N  R  S  P  T  T  G  T  E  K  V  Q  I  S  S  T  T
       - Q  F  L  T  G  R  Q  R  Q  V  L  K  K  F  K  S  H  L  P  L
13681 - TGTACCATGGTGTATATAGTGCAGTCGCAGATTGATTTATGTGTTACCGACTAAATCAGA - 13740
       - C  T  M  V  Y  I  V  Q  S  Q  I  D  L  C  V  T  D  *  I  R
       - V  P  W  C  I  *  C  S  R  R  L  I  Y  V  L  P  T  K  S  D
       - Y  H  G  V  Y  S  A  V  A  D  *  F  M  C  Y  R  L  N  Q  I
13741 - TACGAGATGCAGTAAAACTACTCCCATTAACACTATGTAATTTTCTTTATGAGCAGTGTA - 13800
       - Y  E  M  Q  *  N  Y  S  H  *  H  Y  V  I  F  F  M  S  S  V
       - T  R  C  S  K  T  T  P  I  N  T  M  *  F  S  L  *  A  V  Y
       - R  D  A  V  K  L  L  P  L  T  L  C  N  F  L  Y  E  Q  C  M
13801 - TGTTAACGACACTACTACTAATAAAGTTATTCTTCCTAACCATACTGAAGCATCTCTTAG - 13860
       - C  *  R  H  Y  Y  *  *  S  Y  S  S  *  P  Y  *  S  I  S  *
       - V  N  D  T  T  T  N  K  V  I  L  P  N  H  T  E  A  S  L  R
       - L  T  T  L  L  L  I  K  L  F  F  L  T  I  L  K  H  L  L  G
13861 - GACTGTAGAATGCGCATATACGATTGAATCCACTCGCACATGCGGTTAGTAATAATTTCT - 13920
       - D  C  R  M  R  I  Y  D  *  I  H  S  H  M  R  L  V  I  I  S
       - T  V  E  C  A  Y  T  I  E  S  T  R  T  C  G  *  *  *  F  L
       - L  *  N  A  H  I  R  L  N  P  L  A  H  A  V  S  N  N  F  *
13921 - GACATGTTAAGACGCTACGATACGCACTACGTCCGTAACATCCGCATGACTGTAATCTAT - 13980
       - D  M  L  R  R  Y  D  T  H  Y  V  R  N  I  R  M  T  V  I  Y
       - T  C  *  D  A  T  I  R  T  T  S  V  T  S  A  *  L  *  S  I
       - H  V  K  T  L  R  Y  A  L  R  P  *  H  P  H  D  C  N  L  L
13981 - TAGTCCTAGAATTACCCTTGACCATGCTAAAGCCACTAAAGCATGTTCATCGTGGTCCGA - 14040
       - *  S  *  N  Y  P  *  P  C  *  S  H  *  S  M  F  I  V  V  R
       - S  P  R  I  T  L  D  H  A  K  A  T  K  A  C  S  S  W  S  D
       - V  L  E  L  P  L  T  M  L  K  P  L  K  H  V  H  R  G  P  T
14041 - CGCCTCAAGGATAACACCTAAGTATAATGAGTAACGACTACGGGTAGGAGTGAAACTGAT - 14100
       - R  L  K  D  N  T  *  V  *  *  V  T  T  T  G  R  S  E  T  D
       - A  S  R  I  T  P  K  Y  N  E  *  R  L  R  V  G  V  K  L  I
       - P  Q  G  *  H  L  S  I  M  S  N  D  Y  G  *  E  *  N  *  S
14101 - CCCGTAACCGACGACTCAGGGTATACCTACGACTAGAGCGTTTTGGTGAATAATTCACCC - 14160
       - P  V  T  D  D  S  G  Y  T  Y  D  *  S  V  L  V  N  N  S  P
       - P  *  P  T  T  Q  G  I  P  T  T  R  A  F  W  *  I  I  H  P
       - R  N  R  R  L  R  V  Y  L  R  L  E  R  F  G  E  *  F  T  L
14161 - TAAACGACTTTATACTAAAATGCCTTCTCTCTGAAACAGAGAAGCTGGCAATAAAATTTA - 14220
       - *  T  T  L  Y  *  N  A  F  S  L  K  Q  R  S  W  Q  *  N  L
       - K  R  L  Y  T  K  M  P  S  L  *  N  R  E  A  G  N  K  I  Y
       - N  D  F  I  L  K  C  L  L  S  E  T  E  K  L  A  I  K  F  I
14221 - TAACCCTGGTCTGTATGGTAGGGTTAACATAATTGACAAACCTACTATCCACATAGGAAG - 14280
       - *  P  W  S  V  W  *  G  *  H  N  *  Q  T  Y  Y  P  H  R  K
       - N  P  G  L  Y  G  R  V  N  I  I  D  K  P  T  I  H  I  G  S
       - T  L  V  C  M  V  G  L  T  *  L  T  N  L  L  S  T  *  E  V
14281 - TAACACGTTTGAAATTACACAATAAAAGATGACACAAAGGTGGATGTTCAAAACCTGGTG - 14340
       - *  H  V  *  N  Y  T  I  K  D  D  T  K  V  D  V  Q  N  L  V
       - N  T  F  E  I  T  Q  *  K  M  T  Q  R  W  M  F  K  T  W  *
       - T  R  L  K  L  H  N  K  R  *  H  K  G  G  C  S  K  P  G  D
14341 - ATCATTCTTTTTATAAACATCTACCACAAGGAAAACAACAAAGTTGACCTATGGTAAAAG - 14400
       - I  I  L  F  I  N  I  Y  H  K  E  N  N  K  V  D  L  W  *  K
       - S  F  F  L  *  T  S  T  T  R  K  T  T  K  L  T  Y  G  K  S
       - H  S  F  Y  K  H  L  P  Q  G  K  Q  Q  S  *  P  M  V  K  A
```

FIG. 5 Cont'd

```
14401 - CACTCAATCCTCAGCATGTATTAGTCCTACATTTGAATGTATCGAGCGCAGAGTCAAAGT - 14460
       - H  S  I  L  S  M  Y  *  S  Y  I  *  M  Y  R  A  Q  S  Q  S
       - T  Q  S  S  A  C  I  S  P  T  F  E  C  I  E  R  R  V  K  V
       - L  N  P  Q  H  V  L  V  L  H  L  N  V  S  S  A  E  S  K  F
14461 - TCCTTGAAAATCACATACGACGACTAGGTCGATACGTACGTCGAAGACCGTTAAATAACG - 14520
       - S  L  K  I  T  Y  D  D  *  V  D  T  Y  V  E  D  R  *  I  T
       - P  *  K  S  H  T  T  T  R  S  I  R  T  S  K  T  V  K  *  R
       - L  E  N  H  I  R  R  L  G  R  Y  V  R  R  R  P  L  N  N  D
14521 - ATCTATTTGCGTGATGTACGAAAAGTCATCGACGTGATTGTTTGTTACAACGAAAAGTTT - 14580
       - I  Y  L  R  D  V  R  K  V  I  D  V  I  V  C  Y  N  E  K  F
       - S  I  C  V  M  Y  E  K  S  S  T  *  L  F  V  T  T  K  S  L
       - L  F  A  *  C  T  K  S  H  R  R  D  C  L  L  Q  R  K  V  *
14581 - GACAGTTTGGGCCATTAAAATTATTTCTGAAAATACTGAAACGACACAGATTTCCAAAGA - 14640
       - D  S  L  G  H  *  N  Y  F  *  K  Y  *  N  D  T  D  F  Q  R
       - T  V  W  A  I  K  I  I  S  E  N  T  E  T  T  Q  I  S  K  E
       - Q  F  G  P  L  K  L  F  L  K  I  L  K  R  H  R  F  P  K  K
14641 - AATTCCTTCCTTCAAGACAACTTGATTTTGTGAAGAAGAAACGAGTCCTACCGTTGCGAC - 14700
       - N  S  F  L  Q  D  N  L  I  L  *  R  R  N  E  S  Y  R  C  D
       - I  P  S  F  K  T  T  *  F  C  E  E  E  T  S  P  T  V  A  T
       - F  L  P  S  R  Q  L  D  F  V  K  K  K  R  V  L  P  L  R  R
14701 - GATAGTCACTAATACTGATAATAGCAATATTAGACGGTTGTTACACACTATAGTCTGTTG - 14760
       - D  S  H  *  Y  *  *  *  Q  Y  *  T  V  V  T  H  Y  S  L  L
       - I  V  T  N  T  D  N  S  N  I  R  R  L  L  H  T  I  V  C  *
       - *  S  L  I  L  I  I  A  I  L  D  G  C  Y  T  L  *  S  V  E
14761 - AGGATAAGCATCAACTTCAACAACTATTTATGAAACTAACAATGCTACCACCGACATAAT - 14820
       - R  I  S  I  N  F  N  N  Y  L  *  N  *  Q  C  Y  H  R  H  N
       - G  *  A  S  T  S  T  T  I  Y  E  T  N  N  A  T  T  D  I  I
       - D  K  H  Q  L  Q  Q  L  F  M  K  L  T  M  L  P  P  T  *  L
14821 - TACGGTTGGTTCATTAGCAATTGTTAGACCTATTTAGTCGACCAAAGGGTAAATTATTTA - 14880
       - Y  G  W  F  I  S  N  C  *  T  Y  L  V  D  Q  R  V  N  Y  L
       - T  V  G  S  L  A  I  V  R  P  I  *  S  T  K  G  *  I  I  Y
       - R  L  V  H  *  Q  L  L  D  L  F  S  R  P  K  G  K  L  F  T
14881 - CCCCATTCCGATCTGAAATAATACTGAGTTACTCAATACTCCTAGTTCTACGTGAAAAGC - 14940
       - P  H  S  D  L  K  *  Y  *  V  T  Q  Y  S  *  F  Y  V  K  S
       - P  I  P  I  *  N  N  T  E  L  L  N  T  P  S  S  T  *  K  A
       - P  F  R  S  E  I  I  L  S  Y  S  I  L  L  V  L  R  E  K  R
14941 - GCATATGATTCGCATTACAGTAGGGATGATATTGAGTTTACTTAGAATTCATACGGTAAT - 15000
       - A  Y  D  S  H  Y  S  R  D  D  I  E  F  T  *  N  S  Y  G  N
       - H  M  I  R  I  T  V  G  M  I  L  S  L  L  R  I  H  T  V  I
       - I  *  F  A  L  Q  *  G  *  Y  *  V  Y  L  E  F  I  R  *  S
15001 - CACGTTTCTTATCTCGAGCGTGGCATCGACCACAGAGATAGACATCATGATACTGTTTAT - 15060
       - H  V  S  Y  L  E  R  G  I  D  H  R  D  R  H  H  D  T  V  Y
       - T  F  L  I  S  S  V  A  S  T  T  E  I  D  I  M  I  L  F  I
       - R  F  L  S  R  A  W  H  R  P  Q  R  *  T  S  *  Y  C  L  S
15061 - CTGTCAAAGTAGTCTTTAATAACTTCAGTTATCGGCGGTGATCTCCTCGATGACACCATT - 15120
       - L  S  K  *  S  L  I  T  S  V  I  G  G  D  L  L  D  D  T  I
       - C  Q  S  S  L  *  *  L  Q  L  S  A  V  I  S  S  M  T  P  L
       - V  K  V  V  F  N  N  F  S  Y  R  R  *  S  P  R  *  H  H  *
15121 - AACCTTGTTCGTTCAAAATGCCACCGACCGTATTATACAATTTTTGACAAATGTCACTAC - 15180
       - N  L  V  R  S  K  C  H  R  P  Y  Y  T  I  F  D  K  C  H  Y
       - T  L  F  V  Q  N  A  T  D  R  I  I  Q  F  L  T  N  V  T  T
       - P  C  S  F  K  M  P  P  T  V  L  Y  N  F  *  Q  M  S  L  H
15181 - ATCTTTGAGGTGTGGAATACCCAACCCTAATAGGTTTTACACTGTCTCGGTACGGATTGT - 15240
       - I  F  E  V  W  N  T  Q  P  *  *  V  L  H  C  L  G  T  D  C
       - S  L  R  C  G  I  P  N  P  N  R  F  Y  T  V  S  V  R  I  V
       - L  *  G  V  E  Y  P  T  L  I  G  F  T  L  S  R  Y  G  L  Y
15241 - ACGAATCCTATTACCGGAGAGAACAAGAACGAGCGTTTGTATTGTGAACGACATTGAATA - 15300
       - T  N  P  I  T  G  E  N  K  N  E  R  L  Y  C  E  R  H  *  I
       - R  I  L  L  P  E  R  T  R  T  S  V  C  I  V  N  D  I  E  *
       - E  S  Y  Y  R  R  E  Q  E  R  A  F  V  L  *  T  T  L  N  S
```

FIG. 5 Cont'd

```
15301 - GTGTGGCAAAGATGTCCAATCGATTGCTCACACGCGTTCATAATTCACTCTACCAGTACA - 15360
       - V  W  Q  R  C  P  I  D  C  S  H  A  F  I  I  H  S  T  S  T
       -  C  G  K  D  V  Q  S  I  A  H  T  R  S  *  F  T  L  P  V  H
       -   V  A  K  M  S  N  R  L  L  T  R  V  H  N  S  L  Y  Q  Y  T
15361 - CACCGCCGAGTGATATACAATTTGGTCCACCTTGTAGTAGGCCACTACGATGTTGACGAA - 15420
       - H  R  R  V  I  Y  N  L  V  H  L  V  V  G  H  Y  D  V  D  E
       -  T  A  E  *  Y  T  I  W  S  T  L  *  *  A  T  T  M  L  T  N
       -   P  P  S  D  I  Q  F  G  P  P  C  S  R  P  L  R  C  *  R  I
15421 - TACGATTATCACAGAAATTGTAAACAGTTCGACAATGTCGGTTACATTTACGTGAAGAAA - 15480
       - Y  D  Y  H  R  N  C  K  Q  F  D  N  V  G  Y  I  Y  V  K  K
       -  T  I  I  T  E  I  V  N  S  S  T  M  S  V  T  F  T  *  R  K
       -   R  L  S  Q  K  L  *  T  V  R  Q  C  R  L  H  L  R  E  E  S
15481 - GTTGACTACCATTATTCTATCGACTGTTCATACAGGCGTTAGATGTTGTGTCCGAGATAC - 15540
       - V  D  Y  H  Y  S  I  D  C  S  Y  R  R  *  M  L  C  P  R  Y
       -  L  T  T  I  I  L  S  T  V  H  T  G  V  R  C  C  V  R  D  T
       -   *  L  P  L  F  Y  R  L  F  I  Q  A  L  D  V  V  S  E  I  L
15541 - TCACAGAGATATCTTTATCCCTACAACTAGTACTTAAGCACCTACTCAAAATGCGAATGG - 15600
       - S  Q  R  Y  L  Y  P  Y  N  *  Y  L  S  T  Y  S  K  C  E  W
       -  H  R  D  I  F  I  P  T  T  S  T  *  A  P  T  Q  N  A  N  G
       -   T  E  I  S  L  S  L  Q  L  V  L  K  H  L  L  K  M  R  M  D
15601 - ACGCATTTGTAAAGAGGTACTACTAAGAAAGACTACTACGGCAACACACGATATTGTCAT - 15660
       - T  H  L  *  R  G  T  T  K  K  D  Y  Y  G  N  T  R  Y  C  H
       -  R  I  C  K  E  V  L  L  R  K  T  T  T  A  T  H  D  I  V  I
       -   A  F  V  K  R  Y  Y  *  E  R  L  L  R  Q  H  T  I  L  S  L
15661 - TGATACGCCGAGTTCCAAATCATCGATCGTAATTCTTGAAATTCCGTCAAGAAATAATAG - 15720
       - *  Y  A  E  F  Q  I  I  D  R  N  S  *  N  S  V  K  K  *  *
       -  D  T  P  S  S  K  S  S  I  V  I  L  E  I  P  S  R  N  N  S
       -   I  R  R  V  P  N  H  R  S  *  F  L  K  F  R  Q  E  I  I  V
15721 - TTTTATTACACAAGTACAGACTCCGTTTTACAACCTGACTCTGACTGGAATGATTTCCTG - 15780
       - F  Y  Y  T  S  T  D  S  V  L  Q  P  D  S  D  W  N  D  F  L
       -  F  I  T  Q  V  Q  T  P  F  Y  N  L  T  L  T  G  M  I  S  W
       -   L  L  H  K  Y  R  L  R  F  T  T  *  L  *  L  E  *  F  P  G
15781 - GAGTGCTTAAAACGAGTGTCGTATGTTACGATCAATTTGTTCCTCTACTAATGCACATGG - 15840
       - E  C  L  K  R  V  S  Y  V  T  I  N  L  F  L  Y  *  C  T  W
       -  S  A  *  N  E  C  R  M  L  R  S  I  C  S  S  T  N  A  H  G
       -   V  L  K  T  S  V  V  C  Y  D  Q  F  V  P  L  L  M  H  M  D
15841 - ACGGAATGGGTCTAGGTAGTTCTTATAATCCGCGTCCGACAAAACAGCTACTATAACAGT - 15900
       - T  E  W  V  *  V  V  L  I  I  R  V  R  Q  N  S  Y  Y  N  S
       -  R  N  G  S  R  *  F  L  *  S  A  S  D  K  T  A  T  I  T  V
       -   G  M  G  L  G  S  S  Y  N  P  R  P  T  K  Q  L  L  *  Q  F
15901 - TTTGTCTACCATGTGAATACTAACTTTCCAAGCACAGTGACCGATAACTACGAATGGGTG - 15960
       - F  V  Y  H  V  N  T  N  F  P  S  T  V  T  D  N  Y  E  W  V
       -  L  S  T  M  *  I  L  T  F  Q  A  Q  *  P  I  T  T  N  G  *
       -   C  L  P  C  E  Y  *  L  S  K  H  S  D  R  *  L  R  M  G  E
15961 - AATGTTTTGTAGGATTAGTCCTCATACGACTACAGAAAGTGAACATAAATGTTATGTAAT - 16020
       - N  V  L  *  D  *  S  S  Y  D  Y  R  K  *  T  *  M  L  C  N
       -  M  F  C  R  I  S  P  H  T  T  T  E  S  E  H  K  C  Y  V  I
       -   C  F  V  G  L  V  L  I  R  L  Q  K  V  N  I  N  V  M  *  S
16021 - CTTTCAATGTACTACTCGAATGACCGGTGTACAACCTGTACATAAGGCATTACGATTGAT - 16080
       - L  S  M  Y  Y  S  N  D  R  C  T  T  C  T  *  G  I  T  I  D
       -  F  Q  C  T  T  R  M  T  G  V  Q  P  V  H  K  A  L  R  L  I
       -   F  N  V  L  L  E  *  P  V  Y  N  L  Y  I  R  H  Y  D  *  L
16081 - TACTATTGTGGAGTGCCATGACCCTTGGACTCAAAATACTCCGATACATGTGTGGTGTAT - 16140
       - Y  Y  C  G  V  P  *  P  L  D  S  K  Y  S  D  T  C  V  V  Y
       -  T  I  V  E  C  H  D  P  W  T  Q  N  T  P  I  H  V  W  C  M
       -   L  L  W  S  A  M  T  L  G  L  K  I  L  R  Y  M  C  G  V  C
16141 - GTCAGAACGTCCGACATCCACGAACACATAACACGTTAAGTGTCTGAAGTGAAGCAACGC - 16200
       - V  R  T  S  D  I  H  E  H  I  T  R  *  V  S  E  V  K  Q  R
       -  S  E  R  P  T  S  T  N  T  *  H  V  K  C  L  K  *  S  N  A
       -   Q  N  V  R  H  P  R  T  H  N  T  L  S  V  *  S  E  A  T  P
```

FIG. 5 Cont'd

```
16201 - CACGGACATAATCCTCTGGTAAGGATACAACGTTCACGACGATACTGGTACAGTAAAGTT - 16260
       - H G H N P L V R I Q R R R Y W Y S K V
       - T D I I L W * G Y N V H D D T G V K L
       - R T * S S G K D T T F T T I L V Q * S C
16261 - GTAGTGTGTTTAATCACAACAGACAATTAGGGATACAAACGTTACGGGGTCCAACACTAC - 16320
       - V V C L I T T D N * G Y K R Y G V Q H Y
       - * C V * S Q Q T I R D T N V T G S N T T
       - S V F N H N R Q L G I Q T L R G P T L Q
16321 - AGTGACTACACTGTGTTGACATAGATCCTCCATACTCGATAATAACGTTCAGTGTATTCG - 16380
       - S D Y T V L T * I L H T R * * R S V Y S
       - V T T L C * H R S S I L D N N V Q C I R
       - * L H C V D I D P P Y S I I T F S V F G
16381 - GAGGGTAATCAAAAGGTAATACACGATTACCAGTCCAAAAACCAAATATGTTTTGTGTA - 16440
       - E G N Q K V I H D Y Q S K N Q I C F C V
       - R V I K R * Y T I T S P K T K Y V F V Y
       - G * S K G N T R L P V Q K P N M F L C T
16441 - CACATCCGTCACTGTTACAGTGACTGAAGTTACGCTATCGTTGTACACTAACCTGATTAC - 16500
       - H I R H C Y S D * S Y A I V V H * P D Y
       - T S V T V T V T E V T L S L Y T N L I T
       - H P S L L Q * L K L R Y R C T L T * L R
16501 - GACCGCTAATGTATGAACGGTTGTGAACATGACTCTCTGAGTTCGAAAAGCGTCGTCTTT - 16560
       - D R * C M N G C E H D S L S S K S V V F
       - T A N V * T V V N M T L * V R K A S S L
       - P L M Y E R L * T * L S E F E K R R L C
16561 - GCGAGTTTCGGTGACTCCTTTGTAAATTCGACAGTATACCATAACGGTGACATGCGCTTC - 16620
       - A S F G D S F V N S T V Y H N G D M R F
       - R V S V T P L * I R Q Y T I T V T C A S
       - E F R * L L C K F D S I P * R * H A L H
16621 - ATGAGAGACTGTCTCTTAACGTAGAAAGTACCCTCCAACCTTTTGGATCTGGTGGTAACT - 16680
       - M R D C L L T * K V P S N L L D L V V T
       - * E T V S * R R K Y P P T F W I W W * L
       - E R L S L N V E S T L Q P F G S G G N L
16681 - TGTCTTTGATACAGAAATGACCAATGGCACATTGATTTTTATCATTTCATGTCTAACCTC - 16740
       - C L * Y R N D Q W H I D F Y H F M S N L
       - V F D T E M T N G T L I F I I S C L T S
       - S L I Q K * P M A H * F L S F H V * P L
16741 - TCATGTGGAAACTTTTTCCACTGATACCACTACGACAACACATGTCTCCATGATGCTGTA - 16800
       - S C G N F F H * Y H Y D N T C L H D A V
       - H V E T F S T D T T T T H V S M M L Y
       - M W K L F P L I P L R Q H M S P * C C M
16801 - TGTTCAACTTACAACCACTAATGAAACACAACTGTAGAGTGTGACATTACGGTGAATCAC - 16860
       - C S T Y N H * * N T T V E C D I T V N H
       - V Q L T T T N E T Q L * S V T L R * I T
       - F N L Q P L M K H N C R V * H Y G E S R
16861 - GTGGATGAGATCACGGTGTTCTCGTGATACACTCTTAATGACCGAACATGGGTTGTGAGT - 16920
       - V D E I T V F S * Y T L N D R T W V V S
       - W M R S R C S R D T L L M T E H G L * V
       - G * D H G V L V I H S * * P N M G C E L
16921 - TGTAGAGTCTACTCAAAAGATCGTTACAACGTTTAATAGTTTTCCAGCCGTACGTTTTCA - 16980
       - C R V Y S K D R Y N V * * F S S R T F S
       - V E S T Q K I V T T F N S F P A V R F H
       - * S L L K R S L Q R L I V F Q P Y V F M
16981 - TGAGATGTGAGGTTCCTGGTGGACCATGACCATTCTCAGTAAAACGGTAGCCTGAACGAG - 17040
       - * D V R F L V D H D H S Q * N G S L N E
       - E M * G S W W T M T I L S K T V A * T R
       - R C E V P G G P * P F S V K R * P E R E
17041 - AGATAATGGGTAGACGAGCGTATCACATATGCCGTACGAGAGTACGTCGACAACTACGGG - 17100
       - R * W V D E R I T Y A V R E Y V D N Y G
       - D N G * T S V S H M P Y E S T S T T T G
       - I M G R R A Y H I C R T R V R R Q L R D
```

FIG. 5 Cont'd

```
17101 - ATACACTTTTCCGTAATTTTATAAACGGGTATCTATTTACATCATCTTAGTATGGACGCG - 17160
      - I  H  F  S  V  I  L  *  T  G  I  Y  L  H  H  L  S  M  D  A
      -  Y  T  F  P  *  F  Y  K  R  V  S  I  Y  I  I  L  V  W  T  R
      -   T  L  F  R  N  F  I  N  G  Y  L  F  T  S  S  *  Y  G  R  A
17161 - CACGCGCGCATCTCACAAAACTATTTAAGTTTCACTTAAGTTGTGATCTTGTCATACAAA - 17220
      - H  A  R  I  S  Q  N  Y  L  S  F  T  *  V  V  I  L  S  Y  K
      -  T  R  A  S  H  K  T  I  *  V  S  L  K  L  *  S  C  H  T  K
      -   R  A  H  L  T  K  L  F  K  F  H  L  S  C  D  L  V  I  Q  K
17221 - AGACGTGACATTTACGTAACGGTCTTTGTTGACGACTGTAACATCAGAAACTACTTTAGA - 17280
      - R  R  D  I  Y  V  T  V  F  V  D  D  C  N  I  R  N  Y  F  R
      -  D  V  T  F  T  *  R  S  L  L  T  T  V  T  S  E  T  T  L  E
      -   T  *  H  L  R  N  G  L  C  *  R  L  *  H  Q  K  L  L  *  R
17281 - GATACCGATGATTAATACTGAACTCACAACAGTTACGATCTGAAGCACGTTTTGTGATGC - 17340
      - D  T  D  D  *  Y  *  T  H  N  S  Y  D  L  K  H  V  L  *  C
      -  I  P  M  I  N  T  E  L  T  T  V  T  I  *  S  T  F  C  D  A
      -   Y  R  *  L  I  L  N  S  Q  Q  L  R  S  E  A  R  F  V  M  Q
17341 - AGATATAACCGCTAGGACGAGTTAATGGTCGGGGGGCGTGTAACGACTGATTTCCGTGTG - 17400
      - R  Y  N  R  *  D  E  L  M  V  G  G  R  V  T  T  D  F  R  V
      -  D  I  T  A  R  T  S  *  W  S  G  G  V  *  R  L  I  S  V  *
      -   I  *  P  L  G  R  V  N  G  R  G  A  C  N  D  *  F  P  C  D
17401 - ATCTTGGTCTTATAAAATTAAGTCACACGTCTGAATACTTTTGTTATCCAGGTCTGTACA - 17460
      - I  L  V  L  *  N  *  V  T  R  L  N  T  F  V  I  Q  V  C  T
      -  S  W  S  Y  K  I  K  S  H  V  *  I  L  L  L  S  R  S  V  Q
      -   L  G  L  I  K  L  S  H  T  S  E  Y  F  C  Y  P  G  L  Y  K
17461 - AGGAACCTTGAACAGCGGCAACAGGACGACTTTAACAACTGTGACACTCACGAAATCAAA - 17520
      - R  N  L  E  Q  R  Q  Q  D  D  F  N  N  C  D  T  H  E  I  K
      -  G  T  L  N  S  G  N  R  T  T  L  T  T  V  T  L  T  K  S  N
      -   E  P  *  T  A  A  T  G  R  L  *  Q  L  *  H  S  R  N  Q  I
17521 - TACTGTTATTCGATTTTCGTGTGTTCCTCTTCAGTCGAGTTACGAAGTTTTACAAGATGT - 17580
      - Y  C  Y  S  I  F  V  C  S  S  S  V  E  L  R  S  F  T  R  C
      -  T  V  I  R  F  S  C  V  P  L  Q  S  S  Y  E  V  L  Q  D  V
      -   L  L  F  D  F  R  V  F  L  F  S  R  V  T  K  F  Y  K  M  F
17581 - TTCCACAATAATGTGTACTACAAAGTAGACGTTAGTTGTCTGGAGTTTATCCGCAACATT - 17640
      - F  H  N  N  V  Y  Y  K  V  D  V  S  C  L  E  F  I  R  N  I
      -  S  T  I  M  C  T  T  K  *  T  L  V  V  W  S  L  S  A  T  F
      -   P  Q  *  C  V  L  Q  S  R  R  *  L  S  G  V  Y  P  Q  H  S
17641 - CTCTTAAAGAATGTGCGTTAGGACGAACCTCTTTTCGACAAAAATAGAGTGGAATATTAA - 17700
      - L  L  K  N  V  R  *  D  E  P  L  F  D  K  N  R  V  E  Y  *
      -  S  *  R  M  C  V  R  T  N  L  F  S  T  K  I  E  W  N  I  K
      -   L  K  E  C  A  L  G  R  T  S  F  R  Q  K  *  S  G  I  L  S
17701 - GTGTCTTGCGACATCGAAGTTTTTAGAATCCTAACGGATGCGTCTGACAACTAAGTAGTG - 17760
      - V  S  C  D  I  E  V  F  R  I  L  T  D  A  S  D  N  *  V  V
      -  C  L  A  T  S  K  F  L  E  S  *  R  M  R  L  T  T  K  *  C
      -   V  L  R  H  R  S  F  *  N  P  N  G  C  V  *  Q  L  S  S  V
17761 - TCCCAAGACTTATACTGATACAGTATAAGTGTGTTTGATGACTTTGTCGTGTGAGAACAT - 17820
      - S  Q  D  L  Y  *  Y  S  I  S  V  F  D  D  F  V  V  *  E  H
      -  P  K  T  Y  T  D  T  V  *  V  C  L  M  T  L  S  C  E  N  I
      -   P  R  L  I  L  I  Q  Y  K  C  V  *  *  L  C  R  V  R  T  L
17821 - TACAGTTGGCAAAGTTACACCGATAGTGTTCCCGTTTTTAACCGTAAAACACGTATTACA - 17880
      - Y  S  W  Q  S  Y  T  D  S  V  P  V  F  N  R  K  T  R  I  T
      -  T  V  G  K  V  T  P  I  V  F  P  F  L  T  V  K  H  V  L  Q
      -   Q  L  A  K  L  H  R  *  C  S  R  F  *  P  *  N  T  Y  Y  R
17881 - GACTATCTCTAGAAATACTGTTTGACGTTAAATGTTCAGATCTTTATGGTGCAGCGTTAC - 17940
      - D  Y  L  *  K  Y  C  L  T  L  N  V  Q  I  F  M  V  Q  R  Y
      -  T  I  S  R  N  T  V  *  R  *  M  F  R  S  L  W  C  S  V  T
      -   L  S  L  E  I  L  F  D  V  K  C  S  D  L  Y  G  A  A  L  H
17941 - ACCGATGTAATGTTCGTCTTTTACATTGACCTGAAAAATTCCTGACATCATTCTAGTAAT - 18000
      - T  D  V  M  F  V  F  Y  I  D  L  K  N  S  *  H  H  S  S  N
      -  P  M  *  C  S  S  F  T  L  T  *  K  I  P  D  I  I  L  V  M
      -   R  C  N  V  R  L  L  H  *  P  E  K  F  L  T  S  F  *  *  *
```

FIG. 5 Cont'd

```
18001 - GACCAGAAGTAGGATGTGTCCGTGGATGTGTGGAGTCGCAACTATATTTCAAGTTCTGAC - 18060
       - D  Q  K  *  D  V  S  V  D  V  W  S  R  N  Y  I  S  S  S  D
       -  T  R  S  R  M  C  P  W  M  C  G  V  A  T  I  F  Q  V  L  T
       -   P  E  V  G  C  V  R  G  C  V  E  S  Q  L  Y  F  K  F  *  L
18061 - TTCCTAATACACAACTGTATGGTCCGTATGGTTTCCTGTACTGGATGGCATCTGAGTAGA - 18120
       - F  L  I  H  N  C  M  V  R  M  V  S  C  T  G  W  H  L  S  R
       -  S  *  Y  T  T  V  W  S  V  W  F  P  V  L  D  G  I  *  V  E
       -   P  N  T  Q  L  Y  G  P  Y  G  F  L  Y  W  M  A  S  E  *  R
18121 - GATACTACCCAAAGTTTTACTTAATGGTTCAGTTACCAATGGGATTATACAAATAGTGGG - 18180
       - D  T  T  Q  S  F  T  *  W  F  S  Y  Q  W  D  Y  T  N  S  G
       -  I  L  P  K  V  L  L  N  G  S  V  T  N  G  I  I  Q  I  V  G
       -   Y  Y  P  K  F  Y  L  M  V  Q  L  P  M  G  L  Y  K  *  W  A
18181 - CGCTTCTTCGATAAGCAGTGCAAGCACGCACCTAACCGAAACTACATCTCCCGACAGTAC - 18240
       - R  F  F  D  K  Q  C  K  H  A  P  N  R  N  Y  I  S  R  Q  Y
       -  A  S  S  I  S  S  A  S  T  H  L  T  E  T  T  S  P  D  S  T
       -   L  L  R  *  A  V  Q  A  R  T  *  P  K  L  H  L  P  T  V  R
18241 - GTTGATCTCTACGACACCCATGATTGGATGGAGAGGTCGATCCTAAAAGATGTCCACAAT - 18300
       - V  D  L  Y  D  T  H  D  W  M  E  R  S  I  L  K  D  V  H  N
       -  L  I  S  T  T  P  M  I  G  W  R  G  R  S  *  K  M  S  T  I
       -   *  S  L  R  H  P  *  L  D  G  E  V  D  P  K  R  C  P  Q  L
18301 - TGAATCATCGACATGGCTGACCAATACAACTGTGACTTTTATTGTGTCTTAAGTGGTCTC - 18360
       - *  I  I  D  M  A  D  Q  Y  N  C  D  F  Y  C  V  L  S  G  L
       -  E  S  S  T  W  L  T  N  T  T  V  T  F  I  V  S  *  V  V  S
       -   N  H  R  H  G  *  P  I  Q  L  *  L  L  L  C  L  K  W  S  Q
18361 - AATTACGTTTTGGAGGTGGTCCACTGGTCAAATTTGTAGAATATGGTGAGTACATATTTC - 18420
       - N  Y  V  L  E  V  V  H  W  S  N  L  *  N  M  V  S  T  Y  F
       -  I  T  F  W  R  W  S  T  G  Q  I  C  R  I  W  *  V  H  I  S
       -   L  R  F  G  G  G  P  L  V  K  F  V  E  Y  G  E  Y  I  F  P
18421 - CGAACGGGACCTTACATCACGCATAATTCTATCATGTTTACGAGTCACTATGTGACTTTC - 18480
       - R  T  G  P  Y  I  T  H  N  S  I  M  F  T  S  H  Y  V  T  F
       -  E  R  D  L  T  S  R  I  I  L  S  C  L  R  V  T  M  *  L  S
       -   N  G  T  L  H  H  A  *  F  Y  H  V  Y  E  S  L  C  D  F  P
18481 - CTAACAGTCTGTCTCAGCACAAGCAGGAAACCCGCGTACCGAAACTCGAATGTAGTTACT - 18540
       - L  T  V  C  L  S  T  S  R  K  P  A  Y  R  N  S  N  V  V  T
       -  *  Q  S  V  S  A  Q  A  G  N  P  R  T  E  T  R  M  *  L  L
       -   N  S  L  S  Q  H  K  Q  E  T  R  V  P  K  L  E  C  S  Y  F
18541 - TCATGAAACAGTTCTAACCTGGACTTTCTTGCACAACAGACACACTGTTTGCACGTTGAA - 18600
       - S  *  N  S  S  N  L  D  F  L  A  Q  Q  T  H  C  L  H  V  E
       -  H  E  T  V  L  T  W  T  F  L  H  N  R  H  T  V  C  T  L  N
       -   M  K  Q  F  *  P  G  L  S  C  T  T  D  T  L  F  A  R  *  T
18601 - CGAAAAGATGAAGTAGTCTATGAATACGGACGACCTTAGTAAGACACCCAAAACTGATAC - 18660
       - R  K  D  E  V  V  Y  E  Y  G  R  P  *  *  D  T  Q  N  *  Y
       -  E  K  M  K  *  S  M  N  T  D  D  L  S  K  T  P  K  T  D  T
       -   K  R  *  S  S  L  *  I  R  T  T  L  V  R  H  P  K  L  I  Q
18661 - AGATATTGGGTAAATACTAACTACAAGTCGTCACCCCGAAATGCCCATTGGAAGTCTCAT - 18720
       - R  Y  W  V  N  T  N  Y  K  S  S  P  R  N  A  H  W  K  S  H
       -  D  I  G  *  I  L  T  T  S  R  H  P  E  M  P  I  G  S  L  I
       -   I  L  G  K  Y  *  L  Q  V  V  T  P  K  C  P  L  E  V  S  L
18721 - TGGTACTGGTTGTAACGGTCCATGTACCTTTACGTGTACACCGATCAACACTACGATAGT - 18780
       - W  Y  W  L  *  R  S  M  Y  L  Y  V  Y  T  D  Q  H  Y  D  S
       -  G  T  G  C  N  G  P  C  T  F  T  C  T  P  I  N  T  T  I  V
       -   V  L  V  V  T  V  H  V  P  L  R  V  H  R  S  T  L  R  *  Y
18781 - ACTGATCTACAAATCGTCAGGTACTCACGAAACAATTCGCGCAACTAACCAGACAACTTA - 18840
       - T  D  L  Q  I  V  R  Y  S  R  N  N  S  R  N  *  P  D  N  L
       -  L  I  Y  K  S  S  G  T  H  E  T  I  R  A  T  N  Q  T  T  Y
       -   *  S  T  N  R  Q  V  L  T  K  Q  F  A  Q  L  T  R  Q  L  M
18841 - TGGGATAATATCCTCTACTTGACTCCCAATTAAGACGAACGTCTTTTCATGTTGTGTACC - 18900
       - W  D  N  I  L  Y  L  T  P  N  *  D  E  R  L  F  M  L  C  T
       -  G  I  I  S  S  T  *  L  P  I  K  T  N  V  F  S  C  C  V  P
       -   G  *  Y  P  L  L  D  S  Q  L  R  R  T  S  F  H  V  V  Y  Q
```

FIG. 5 Cont'd

```
18901 - AACACTTCAGACGTAACGAACGACTATTCAAAGGTCAAGAAGTACTGTAACCTTTAGGTT - 18960
      - N T S D V T N D Y S K V K K Y C N L * V
      -  T L Q T * R T T I Q R S R S T V T F R F
      -   H F R R N E R L F K G Q E V L * P L G F
18961 - TCCGATAGTTCACACACGGAGTCCGACTTCATCTTACCTTCAAGATGCTACGAGTCGGTA - 19020
      - S D S S H T E S D F I L P S R C Y E S V
      -  P I V H T R S P T S S Y L Q D A T S R Y
      -   R * F T H G V R L H L T F K M L R V G T
19021 - CATCACTGTTTCGAATGTTTTATCTCCTCGAAGAAGATAAGAATACGATGTGTAGTGCTAT - 19080
      - H H C F E C F I S S R R * E Y D V * C Y
      -  I T V S N V L S P R E D K N T M C S A I
      -   S L F R M F Y L L E K I R I R C V V L F
19081 - TTAAGTGACTACCACAAACAAACAAAACCTTAACATTGCAACTAGCAATGGGTCGGTTAC - 19140
      - L S D Y H K Q T K P * H C N * Q W V G Y
      -  * V T T T N K Q N L N I A T S N G S V T
      -   K * L P Q T N K T L T L Q L A M G R L R
19141 - GTTAACACACATCCAAACTGTGTTCTCAGAACAGTTTGAACTTGAATGGTCCGACACTAC - 19200
      - V N T H P N C V L R T V * T * M V R H Y
      -  L T H I Q T V F S E Q F E L E W S D T T
      -   * H T S K L C S Q N S L N L N G P T L P
19201 - CACCATCAAACATACACTTATTCGTACGTAAGGTGTGAGGTCGAAAGCTATTTTCACGTA - 19260
      - H H Q T Y T Y S Y V R C E V E S Y F H V
      -  T I K H T L I R T * G V R S K A I F T *
      -   P S N I H L F V R K V * G R K L F S R K
19261 - AATGATTAAATTTCGTTAACGGAAAGAAAATGATAAGACTATCAGGAACACTCAGAGTAC - 19320
      - N D * I S L T E R K * * D Y Q E H S E Y
      -  M I K F R * R K E N D K T I R N T Q S T
      -   * L N F V N G K K M I R L S G T L R V P
19321 - CGTTTGTTCATCACAGCCTATAACTAATACAAGGTGAGTTTAGACGATGCACATAATGTG - 19380
      - R L F I T A Y N * Y K V S L D D A H N V
      -  V C S S Q P I T N T R * V * T M H I M C
      -   F V H H S L * L I Q G E F R R C T * C A
19381 - CTACGTTAAATCCACCACGACAAACGTCTGTGGTACGTTTACTCATGGCTGTCATGAACC - 19440
      - L R * I H H D K R L W Y V Y S W L S * T
      -  Y V K S T T T N V C G T F T H G C H E P
      -   T L N P P R Q T S V V R L L M A V M N L
19441 - TACGTATATTATACTACTAAAGACGACCTAAATCGGATACCTAAATGTTTGTTAAACTAT - 19500
      - Y V Y Y T T K D D L N R I P K C L L N Y
      -  T Y I I L L K T T * I G Y L N V C * T M
      -   R I L Y Y * R R P K S D T * M F V K L *
19501 - GAATATTGGACACCTTATGTAAATGGTCCAATGTCTCAAATCTTTTACACCGAATATTAC - 19560
      - E Y W T P Y V N G P M S Q I F Y T E Y Y
      -  N I G H L M * M V Q C L K S F T P N I T
      -   I L D T L C K W S N V S N L L H R I L Q
19561 - AACAATTATTTCCTGTGAAACTACCTGTGCGGCCGCTTCGTGGACAAAGGTAGTAATTAT - 19620
      - N N Y F L * N Y L C G R F V D K G S N Y
      -  T I I S C E T T C A A A S W T K V V I I
      -   Q L F P V K L P V R P L R G Q R * * L L
19621 - TACGACAAATGTGTTTCCATCTACCATAACTACACCTCTAGAAACTTTTATTCTGTTGTG - 19680
      - Y D K C V S I Y H N Y T S R N F Y S V V
      -  T T N V F P S T I T T P L E T F I L L *
      -   R Q M C F H L P * L H L * K L L F C C E
19681 - AAGGACAATTACAACGTAAACTCGAAACCCGATTCGCATTGTAATTTGGTCACGGTCTCT - 19740
      - K D N Y N V N S K P D S H C N L V T V S
      -  R T I T T * T R N P I R I V I W S R S L
      -   G Q L Q R K L E T R F A L * F G H G L *
19741 - AATTCTATGAGTTATTAAACCCACAACTATAGCGACGATTATGACATTAGACCCTGATGT - 19800
      - N S M S Y * T H N Y S D D Y D I R P * C
      -  I L * V I K P T T I A T I M T L D P D V
      -   F Y E L L N P Q L * R R L * H * T L M F
```

FIG. 5 Cont'd

```
19801 - TTTCTCTTCGGGGTCGTGTACATAGATGTTATCCACAGACGTGTTACTGACTGTAACGGT - 19860
      - F  L  F  G  V  V  Y  I  D  V  I  H  R  R  V  T  D  C  N  G
      -  F  S  S  G  S  C  T  *  M  L  S  T  D  V  L  L  T  V  T  V
      -   S  L  R  G  R  V  H  R  C  Y  P  Q  T  C  Y  *  L  *  R  F
19861 - TCTTTGGATGACTCTCACGAACAAGAAGTGAATGACAGAACAAACTACCATCTCACCTTC - 19920
      - S  L  D  D  S  H  E  Q  E  V  N  D  R  T  N  Y  H  L  T  F
      -  L  W  M  T  L  T  N  K  K  *  M  T  E  Q  T  T  I  S  P  S
      -   F  G  *  L  S  R  T  R  S  E  *  Q  N  K  L  P  S  H  L  P
19921 - CTGTCCATCTGGAAAAATCTTTGCGGGCATTACCACAAAATTATTGTCTTCCAAGTCAGT - 19980
      - L  S  I  W  K  N  L  C  G  H  Y  H  K  I  I  V  F  Q  V  S
      -  C  P  S  G  K  I  F  A  G  I  T  T  K  L  L  S  S  K  S  V
      -   V  H  L  E  K  S  L  R  A  L  P  Q  N  Y  C  L  P  S  Q  F
19981 - TTCCAGATTGTGGAAGTTTCCCTGGTCGTGTTCGATCGCAGTTACCTCAGTGTAATTAAC - 20040
      - F  Q  I  V  E  V  S  L  V  V  F  D  R  S  Y  L  S  V  I  N
      -  S  R  L  W  K  F  P  W  S  C  S  I  A  V  T  S  V  *  L  T
      -   P  D  C  G  S  F  P  G  R  V  R  S  Q  L  P  Q  C  N  *  P
20041 - CTCTTAGTCATTTTTGTGTCAAATTGATGAAATTCTTTCATCTGCCGTAATAAGTTGTCA - 20100
      - L  L  V  I  F  V  S  N  *  *  N  S  F  I  C  R  N  K  L  S
      -  S  *  S  F  L  C  Q  I  D  E  I  L  S  S  A  V  I  S  C  Q
      -   L  S  H  F  C  V  K  L  M  K  F  F  H  L  P  *  *  V  V  N
20101 - ACGGACTTTGGATGAAATGAGTCTCGTCTCTGAATCTCCTAAAATTCGGGTCTAGTGTTT - 20160
      - T  D  F  G  *  N  E  S  R  L  *  I  S  *  N  S  G  L  V  F
      -  R  T  L  D  E  M  S  L  V  S  E  S  P  K  I  R  V  *  C  L
      -   G  L  W  M  K  *  V  S  S  L  N  L  L  K  F  G  S  S  V  Y
20161 - ACCTTTGACTGAAAGAGCTCGAGCGATACCTACTTAAGTATGTCGCTATATTCGAGCTCC - 20220
      - T  F  D  *  K  S  S  S  D  T  Y  L  S  M  S  L  Y  S  S  S
      -  P  L  T  E  R  A  R  A  I  P  T  *  V  C  R  Y  I  R  A  P
      -   L  *  L  K  E  L  E  R  Y  L  L  K  Y  V  A  I  F  E  L  P
20221 - CGATACGGAAGCTTGTGTAGCAAATACCTCTAAAGTCAGTACCTGTTGAACCGCCAGAAG - 20280
      - R  Y  G  S  L  C  S  K  Y  L  *  S  Q  Y  L  L  N  R  Q  K
      -  D  T  E  A  C  V  A  N  T  S  K  V  S  T  C  *  T  A  R  S
      -   I  R  K  L  V  *  Q  I  P  L  K  S  V  P  V  E  P  P  E  V
20281 - TAAATTACTATCCGAATCGGTTCGCGAGTGTTCTAAGTGGTGAATTTAATCTCCTAAAAT - 20340
      - *  I  T  I  R  I  G  S  R  V  F  *  V  V  N  L  I  S  *  N
      -  K  L  L  S  E  S  V  R  E  C  S  K  W  *  I  *  S  P  K  I
      -   N  Y  Y  P  N  R  F  A  S  V  L  S  G  E  F  N  L  L  K  *
20341 - AGGGATACCTGTCGTGTCACTTTTTAATGAAGTATTGTCTACGCGTTTGTCCAAGTAGTT - 20400
      - R  D  T  C  R  V  T  F  *  *  S  I  V  Y  A  F  V  Q  V  V
      -  G  I  P  V  V  S  L  F  N  E  V  L  S  T  R  L  S  K  *  F
      -   G  Y  L  S  C  H  F  L  M  K  Y  C  L  R  V  C  P  S  S  F
20401 - TTACACACACAAGACACTAACTAGAAAATGAACTACTGAAACAGCTCTATTATTTCAGTG - 20460
      - L  H  T  Q  D  T  N  *  K  M  N  Y  *  N  S  S  I  I  S  V
      -  Y  T  H  K  T  L  T  R  K  *  T  T  E  T  A  L  L  F  Q  C
      -   T  H  T  R  H  *  L  E  N  E  L  L  K  Q  L  Y  Y  F  S  V
20461 - TTCTAAACAGTCACTAAAGTTTTCACCAGTTCCAATGTTAACTGATACGACTTTAAAGTA - 20520
      - F  *  T  V  T  K  V  F  T  S  S  N  V  N  *  Y  D  F  K  V
      -  S  K  Q  S  L  K  F  S  P  V  P  M  L  T  D  T  T  L  K  *
      -   L  N  S  H  *  S  F  H  Q  F  Q  C  *  L  I  R  L  *  S  K
20521 - AGTACGAAACCACATTCCTACCTGTACAACTTTGGAAGATGGGTTTTGATGTTCGTTCAG - 20580
      - S  T  K  P  H  S  Y  L  Y  N  F  G  R  W  V  L  M  F  V  Q
      -  V  R  N  H  I  P  T  C  T  T  L  E  D  G  F  *  C  S  F  S
      -   Y  E  T  T  F  L  P  V  Q  L  W  K  M  G  F  D  V  R  S  V
20581 - TTCGCACCGTTGGTCCACAACGCTACGGATTGAACATGTTCTACGTTTCTTACGAAGAAC - 20640
      - F  A  P  L  V  H  N  A  T  D  *  T  C  S  T  F  L  T  K  N
      -  S  H  R  W  S  T  T  L  R  I  E  H  V  L  R  F  L  R  R  T
      -   R  T  V  G  P  Q  R  Y  G  L  N  M  F  Y  V  S  Y  E  E  L
20641 - TTTTCACACTGGAAGTCTTAATACCACTTTTACGACAATATGGTTTTCCTTATTACTACT - 20700
      - F  S  H  W  K  S  *  Y  H  F  Y  D  N  M  V  F  L  I  T  T
      -  F  H  T  G  S  L  N  T  T  F  T  T  I  W  F  S  L  L  L  L
      -   F  T  L  E  V  L  I  P  L  L  R  Q  Y  G  F  P  Y  Y  Y  L
```

FIG. 5 Cont'd

```
20701 - TACAGCGTTTCATATGAGTTGACACAGTTATGAATTTATGTGAATGAAATCGACATGGGA - 20760
      - Y S V S Y E L T Q L * I Y V N E I D M G
      - T A F H M S * H S Y E F M * M K S T W D
      - Q R F I * V D T V M N L C E * N R H G M
20761 - TGTTGTACTCTCAATAAGTGAAACCACGACCGAGACTATTTCCTCAACGTGGTCCATGTC - 20820
      - C C T L N K * N H D R D Y F L N V V H V
      - V V L S I S E T T T E T I S S T W S M S
      - L Y S Q * V K P R P R L F P Q R G P C R
20821 - GACACGAGTCTGTTACCAACGGTTGACCGTGTGATGAACAGCTAAGTCTAGAATTACTGA - 20880
      - D T S L L P T V D R V M N S * V * N Y *
      - T R V C Y Q R L T V * * T A K S R I T E
      - H E S V T N G * P C D E Q L S L E L L K
20881 - AGCAGAGGCTGCGTCTAAGATGAAATTAACCTCTGACACGTTGTCATGTATGCCGATTAT - 20940
      - S R G C V * D E I N L * H V V M Y A D Y
      - A E A A S K M K L T S D T L S C M P I I
      - Q R L R L R * N * P L T R C H V C R L F
20941 - TTACCCTGGAATAATAATCGCTATACATACTGGGATCCTGGTTTGTACACTGTTTTCTCT - 21000
      - L P W N N N R Y T Y W D P G L Y T V F S
      - Y P G I I I A I H T G I L V C T L F S L
      - T L E * * S L Y I L G S W F V H C F L L
21001 - TACTGAGATTTCTTCCCAAAAAGTGAATAGACACACCTAAATATTTCGTTTTTGATCGGG - 21060
      - Y * D F F P K S E * T H L N I S F L I G
      - T E I S S Q K V N R H T * I F R F * S G
      - L R F L P K K * I D T P K Y F V F D R D
21061 - ACCCACCAAGATATCGACATTTCTATTGTCTCGTAAGAACCTTACGACTGGAAATGTTCG - 21120
      - T H Q D I D I S I V S * E P Y D W K C S
      - P T K I S T F L L S R K N L T T G N V R
      - P P R Y R H F Y C L V R T L R L E M F E
21121 - AATACCCGGTAAAGAGTACCACCTGTCGAAAACAATGTTTACATTTACGTAGTAGTAGCC - 21180
      - N T R * R V P P V E N N V Y I Y V V V A
      - I P G K E Y H L S K T M F T F T * * * P
      - Y P V K S T T C R K Q C L H L R S S S L
21181 - TTCGTAAAAATTAACCCCGATTGATAGAACCGTTCGGCTTCCTTGTTTAACTACCGATAT - 21240
      - F V K I N P D * * N R S A S L F N Y R Y
      - S * K L T P I D R T V R L P C L T T D M
      - R K N * P R L I E P F G F L V * L P I W
21241 - GGTACGTACGATTGATGTAAAAGACCTCCTTGTGTTTAGGATAGGTCAACAGAAGGATAA - 21300
      - G T Y D * C K R P. C V * D R S T E G *
      - V R T I D V K D L L V F R I G Q Q K D K
      - Y V R L M * K T S L C L G * V N R R I S
21301 - GTGAGAAACTGTACTCGTTTAAAGGAGAATTTAATTCTCCTTGACGACATTACAGAGAAT - 21360
      - V R N C T R L K E N L I L L D D I T E N
      - * E T V L V * R R I * F S L T T L Q R I
      - E K L Y S F K G E F N S P * R H Y R E F
21361 - TCCTCTTAGTTTAGTTACTATACTAAATAAGAGAAGACCTTTTTCCATCCGAATAGTAAT - 21420
      - S S * F S Y Y T K * E K T F F H P N S N
      - P L S L V T I L N K R R P F S I R I V I
      - L L V * L L Y * I R E D L F P S E * * S
21421 - CTCTTTTGTTGTCTCAACACCAAAGTTCACTATAAGAACAATTGTTGATTTGCTTGTACA - 21480
      - L F C C L N T K V H Y K N N C * F A C T
      - S F V V S T P K F T I R T I V D L L V Q
      - L L L S Q H Q S S L * E Q L L I C L Y K
21481 - AATAAAAGAATAATAAAGAATGAGAGTGATCACCATCACTGGAACTGGCCACGTGGTGAA - 21540
      - N K R I I K N E S D H H H W N W P R G E
      - I K E * * R M R V I T I T G T G H V V K
      - * K N N K E * E * S P S L E L A T W * K
21541 - AACTACTACAAGTTCGAGGATTAATGTGAGTTGTATGAAGTAGATACTCCCCCCAAATGA - 21600
      - N Y Y K F E D * C E L Y E V D T P P K *
      - T T T S S R I N V S C M K * I L P P N D
      - L L Q V R G L M * V V * S R Y S P Q M I
```

FIG. 5 Cont'd

```
21601 - TAGGACTACTTTAAAAATCTAGTCTGTGAGAAATAAATTGAGTCCTAAATAAAGAAGGTA - 21660
       -  *  D  Y  F  K  N  L  V  C  E  K  *  I  E  S  *  I  K  K  V
       -  R  T  T  L  K  I  *  S  V  R  N  K  L  S  P  K  *  R  R  *
       -  G  L  L  *  K  S  S  L  *  E  I  N  *  V  L  N  K  E  G  K
21661 - AAATAAGATTACAATGTCCCAAAGTATGATAATTAGTATGCAAACTGTTGGGACAGTATG - 21720
       -  K  *  D  Y  N  V  P  K  Y  D  N  *  Y  A  N  C  W  D  S  M
       -  N  K  I  T  M  S  Q  S  M  I  I  S  M  Q  T  V  G  T  V  W
       -  I  R  L  Q  C  P  K  V  *  *  L  V  C  K  L  L  G  Q  Y  G
21721 - GAAAATTCCTACCATAAATAAAACGACGGTGTCTCTTTAGTTTACAACAGGCACCAACCC - 21780
       -  E  N  S  Y  H  K  *  N  D  G  V  S  L  V  Y  N  R  H  Q  P
       -  K  I  P  T  I  N  K  T  T  V  S  L  *  F  T  T  G  T  N  P
       -  K  F  L  P  *  I  K  R  R  C  L  F  S  L  Q  Q  A  P  T  Q
21781 - AAAAACCAAGATGGTACTTGTTGTTCAGTGTCAGCCACTAATAATAATTGTTAAGATGAT - 21840
       -  K  N  Q  D  G  T  C  C  S  V  S  A  T  N  N  N  C  *  D  D
       -  K  T  K  M  V  L  V  V  Q  C  Q  P  L  I  I  I  V  K  M  I
       -  K  P  R  W  Y  L  L  F  S  V  S  H  *  *  *  L  L  R  *  L
21841 - TACAACAATATGCTCGTACATTGAAACTTAACACACTGTTGGGAAAGAAACGACAAAGAT - 21900
       -  Y  N  N  M  L  V  H  *  N  L  T  H  C  W  E  R  N  D  K  D
       -  T  T  I  C  S  Y  I  E  T  *  H  T  V  G  K  E  T  T  K  I
       -  Q  Q  Y  A  R  T  L  K  L  N  T  L  L  G  K  K  R  Q  R  F
21901 - TTGGGTACCCATGTGTCTGTGTATGATACTATAAGCTATTACGTAAATTAACGTGAAAGC - 21960
       -  L  G  T  H  V  S  V  Y  D  T  I  S  Y  Y  V  N  *  R  E  S
       -  W  V  P  M  C  L  C  M  I  L  *  A  I  T  *  I  N  V  K  A
       -  G  Y  P  C  V  C  V  *  Y  Y  K  L  L  R  K  L  T  *  K  L
21961 - TCATGTATAGACTACGGAAAAGCGAACTACAAAGTCTTTTCAGTCCATTAAAATTTGTGA - 22020
       -  S  C  I  D  Y  G  K  A  N  Y  K  V  F  S  V  H  *  N  L  *
       -  H  V  *  T  T  E  K  R  T  T  K  S  F  Q  S  I  K  I  C  E
       -  M  Y  R  L  R  K  S  E  L  Q  S  L  F  S  P  L  K  F  V  N
22021 - ATGCTCTCAAACACAAATTTTTATTTCTACCCAAAGAGATACAAATATTCCCGATAGTTG - 22080
       -  M  L  S  N  T  N  F  Y  F  Y  P  K  R  Y  K  Y  S  R  *  L
       -  C  S  Q  T  Q  I  F  I  S  T  Q  R  D  T  N  I  P  D  S  W
       -  A  L  K  H  K  F  L  F  L  P  K  E  I  Q  I  F  P  I  V  G
22081 - GATATCTACATCAAGCACTAGATGGAAGACCAAAATTGTGAAACTTTGGATAAAAATTCA - 22140
       -  D  I  Y  I  K  H  *  M  E  D  Q  N  C  E  T  L  D  K  N  S
       -  I  S  T  S  S  T  R  W  K  T  K  I  V  K  L  W  I  K  I  Q
       -  Y  L  H  Q  A  L  D  G  R  P  K  L  *  N  F  G  *  K  F  N
22141 - ACGGAGAACCATAATTGTAATGTTTAAAATCTCGGTAAGAATGTCGGAAAAGTGGACGAG - 22200
       -  T  E  N  H  N  C  N  V  *  N  L  G  K  N  V  G  K  V  D  E
       -  R  R  T  I  I  V  M  F  K  I  S  V  R  M  S  E  K  W  T  S
       -  G  E  P  *  L  *  C  L  K  S  R  *  E  C  R  K  S  G  R  V
22201 - TTCTGTGAACCCCGTGCAGTCGACGTCGGATAAAACAACCGATAAATTTCGGTTGATGTA - 22260
       -  F  C  E  P  R  A  V  D  V  G  *  N  N  R  *  I  S  V  D  V
       -  S  V  N  P  V  Q  S  T  S  D  K  T  T  D  K  F  R  L  M  *
       -  L  *  T  P  C  S  R  R  R  I  K  Q  P  I  N  F  G  *  C  K
22261 - AATACGAGTTCATACTACTTTTACCATGTTAGTGTCTACGACAACTAACAAGAGTTTTAG - 22320
       -  N  T  S  S  Y  Y  F  Y  H  V  S  V  Y  D  N  *  Q  E  F  *
       -  I  R  V  H  T  T  F  T  M  L  V  S  T  T  T  N  K  S  F  R
       -  Y  E  F  I  L  L  L  P  C  *  C  L  R  Q  L  T  R  V  L  G
22321 - GTGAACGACTTGAGTTTACGAGACAATTCTCGAAACTCTAACTGTTTCCTTAAATGGTCT - 22380
       -  V  N  D  L  S  L  R  D  N  S  R  N  S  N  C  F  L  K  W  S
       -  *  T  T  *  V  Y  E  T  I  L  E  T  L  T  V  S  L  N  G  L
       -  E  R  L  E  F  T  R  Q  F  S  K  L  *  L  F  P  *  M  V  W
22381 - GGAGATTAAAGTCCCAACAAGGGAGTCCTCTACAACACTCTAAGGGATTATAATGTTTGA - 22440
       -  G  D  *  S  P  N  K  G  V  L  Y  N  T  L  R  D  Y  N  V  *
       -  E  I  K  V  P  T  R  E  S  S  T  T  L  *  G  I  I  M  F  E
       -  R  L  K  S  Q  Q  G  S  P  L  Q  H  S  K  G  L  *  C  L  N
22441 - ACACAGGAAAACCTCTCCAAAAATTACGATGATTTAAGGGAAGACAGATACGTACCCTCT - 22500
       -  T  Q  E  N  L  S  K  N  Y  D  D  L  R  E  D  R  Y  V  P  S
       -  H  R  K  T  S  P  K  I  T  M  I  *  G  K  T  D  T  Y  P  L
       -  T  G  K  P  L  Q  K  L  R  *  F  K  G  R  Q  I  R  T  L  S
```

FIG. 5 Cont'd

```
22501 - CTTTTTTTTAAAGATTAACACAACGACTAATGAGACACGAGATGTTGAGTTGTAAAAAAA - 22560
      - L  F  F  K  D  *  H  N  D  *  *  D  T  R  C  *  V  V  K  K
      -  F  F  L  K  I  N  T  T  T  N  E  T  R  D  V  E  L  *  K  K
      -   F  F  *  R  L  T  Q  R  L  M  R  H  E  M  L  S  C  K  K  S
22561 - GTTGGAAATTCACGATACCGCAAAGACGGTGATTCAACTTACTAGAAACGAAGAGGTTAC - 22620
      - V  G  N  S  R  Y  R  K  D  G  D  S  T  Y  *  K  R  R  G  Y
      -  L  E  I  H  D  T  A  K  T  V  I  Q  L  T  R  N  E  E  V  T
      -   W  K  F  T  I  P  Q  R  R  *  F  N  L  L  E  T  K  R  L  Q
22621 - AGATACGTCTAAGAAAACATCAGTTCCCTCTACTACATTCTGTTTATCGCGGTCCTGTTT - 22680
      - R  Y  V  *  E  N  I  S  S  L  Y  Y  I  L  F  I  A  V  L  F
      -  D  T  S  K  K  T  S  V  P  S  T  T  F  C  L  S  R  S  C  L
      -   I  R  L  R  K  H  Q  F  P  L  L  H  S  V  Y  R  G  P  V  *
22681 - GACCACAATAACGACTAATATTAATATTTAACGGTCTACTAAAGTACCCAACACAGGAAC - 22740
      - D  H  N  N  *  Y  *  Y  L  T  V  Y  *  S  T  Q  H  R  N
      -  T  T  I  T  T  N  I  N  I  *  R  S  T  K  V  P  N  T  G  T
      -   P  Q  *  R  L  I  L  I  F  N  G  L  L  K  Y  P  T  Q  E  R
22741 - GAACCTTATGATCCTTGTAACTACGATGAAGTTGACCATTAATATTAATATTTATATCCA - 22800
      - E  P  Y  D  P  C  N  Y  D  E  V  D  H  *  Y  *  Y  L  Y  P
      -  N  L  M  I  L  V  T  T  M  K  L  T  I  N  I  N  I  Y  I  H
      -   T  L  *  S  L  *  L  R  *  S  *  P  L  I  L  I  F  I  S  I
22801 - TAGAATCTGTACCGTTCGAATCCGGGAAACTCTCTCTGTATAGATTACACGGAAAGAGGG - 22860
      - *  N  L  Y  R  S  N  P  G  N  S  L  C  I  D  Y  T  E  R  G
      -  R  I  C  T  V  R  I  R  E  T  L  S  V  *  I  T  R  K  E  G
      -   E  S  V  P  F  E  S  G  K  L  S  L  Y  R  L  H  G  K  R  G
22861 - GACTACCGTTTGGAACGTGGGGTGGACGAGAATTAACAATAACCGGTAATTTACTAATAC - 22920
      - D  Y  R  L  E  R  G  V  D  E  N  *  Q  *  P  V  I  Y  *  Y
      -  T  T  V  W  N  V  G  W  T  R  I  N  N  N  R  *  F  T  N  T
      -   L  P  F  G  T  W  G  G  R  E  L  T  I  T  G  N  L  L  I  P
22921 - CAAAAATGTGGTGATGACCGTAACCGATGGTTGGAATGTCTCAACATCATGAAAGAAAAC - 22980
      - Q  K  C  G  D  D  R  N  R  W  L  E  C  L  N  I  M  K  E  N
      -  K  N  V  V  M  T  V  T  D  G  W  N  V  S  T  S  *  K  K  T
      -   K  M  W  *  *  P  *  P  M  V  G  M  S  Q  H  H  E  R  K  L
22981 - TTGAAAATTTACGTGGCCGGTGCCAAACACCTGGTTTTAATAGGTGACTGGAATAATTCT - 23040
      - L  K  I  Y  V  A  G  A  K  H  L  V  L  I  G  D  W  N  N  S
      -  *  K  F  T  W  P  V  P  N  T  W  F  *  *  V  T  G  I  I  L
      -   E  N  L  R  G  R  C  Q  T  P  G  F  N  R  *  L  E  *  F  L
23041 - TGGTCACACAGTTAAAATTAAAATTACCTGAGTGACCATGACCACACAATTGAGGAAGAA - 23100
      - W  S  H  S  *  N  *  N  Y  L  S  D  H  D  H  T  I  E  E  E
      -  G  H  T  V  K  I  K  I  T  *  V  T  M  T  T  Q  L  R  K  K
      -   V  T  Q  L  K  L  K  L  P  E  *  P  *  P  H  N  *  G  R  S
23101 - GTTTCTCTAAAGTTGGTAAAGTTGTTAAACCGGCACTACAAAGACTAAAGTGACTAAGGC - 23160
      - V  S  L  K  L  V  K  L  L  N  R  H  Y  K  D  *  S  D  *  G
      -  F  L  *  S  W  *  S  C  *  T  G  T  T  K  T  K  V  T  K  A
      -   F  S  K  V  G  K  V  V  K  P  A  L  Q  R  L  K  *  L  R  Q
23161 - AAGCTCTAGGATTTTGTAGACTTTATAATCTGTAAAGTGGAACGAGAAAACCCCCACATT - 23220
      - K  L  *  D  F  V  D  F  I  I  C  K  V  E  R  E  N  P  H  I
      -  S  S  R  I  L  *  T  L  *  S  V  K  W  N  E  K  T  P  T  F
      -   A  L  G  F  C  R  L  Y  N  L  *  S  G  T  R  K  P  P  H  S
23221 - CACATTAATGTGGACCTTGTTTACGAAGTAGACTTCAACGACAAGATATAGTTCTACAAT - 23280
      - H  I  N  V  D  L  V  Y  E  V  D  F  N  D  K  I  *  F  Y  N
      -  T  L  M  W  T  L  F  T  K  *  T  S  T  T  R  Y  S  S  T  I
      -   H  *  C  G  P  C  L  R  S  R  L  Q  R  Q  D  I  V  L  Q  L
23281 - TGACGTGACTACAAAGATGTCGTTAAGTACGTCTAGTTGAGTGTGGTCGAACCGCGTATA - 23340
      - *  R  D  Y  K  D  V  V  K  Y  V  *  L  S  V  V  E  P  R  I
      -  D  V  T  T  K  M  S  L  S  T  S  S  *  V  W  S  N  R  V  Y
      -   T  *  L  Q  R  C  R  *  V  R  L  V  E  C  G  R  T  A  Y  I
23341 - TAAGATGACCTTTGTTACATAAGGTCTGAGTTCGTCCGACAGAATATCCTCGACTCGTAC - 23400
      - *  D  D  L  C  Y  I  R  S  E  F  V  R  Q  N  I  L  D  S  Y
      -  K  M  T  F  V  T  *  G  L  S  S  S  D  R  I  S  S  T  R  T
      -   R  *  P  L  L  H  K  V  *  V  R  P  T  E  Y  P  R  L  V  Q
```

FIG. 5 Cont'd

```
23401 - AGCTGTGAAGAATACTCACGCTGTAAGGATAACCTCGACCGTAAACACGATCAATGGTAT - 23460
      -  S  C  E  E  Y  S  R  C  K  D  N  L  D  R  K  H  D  Q  W  Y
      -  A  V  K  N  T  H  A  V  R  I  T  S  T  V  N  T  I  N  G  M
      -  L  *  R  I  L  T  L  *  G  *  P  R  P  *  T  R  S  M  V  C
23461 - GTCAAAGAAATAATGCATCATGATCGGTTTTTAGATAACACCGAATATGATACAGAAATC - 23520
      -  V  K  E  I  M  H  H  D  R  F  L  D  N  T  E  Y  D  T  E  I
      -  S  K  K  *  C  I  M  I  G  F  *  I  T  P  N  M  I  Q  K  S
      -  Q  R  N  N  A  S  *  S  V  F  R  *  H  R  I  *  Y  R  N  P
23521 - CACGACTATCAAGTTAACGAATGAGATTATTGTGGTAACGATATGGATGATTGAAAAGTT - 23580
      -  H  D  Y  Q  V  N  E  *  D  Y  C  G  N  D  M  D  D  *  K  V
      -  T  T  I  K  L  T  N  E  I  I  V  V  T  I  W  M  I  E  K  L
      -  R  L  S  S  *  R  M  R  L  L  W  *  R  Y  G  *  L  K  S  *
23581 - AATCGTAATGATGTCTTCATTACGGACAAAGATACCGATTTTGGAGGCATCTAACATTAT - 23640
      -  N  R  N  D  V  F  I  T  D  K  D  T  D  F  G  G  I  *  H  Y
      -  I  V  M  M  S  S  L  R  T  K  I  P  I  L  E  A  S  N  I  I
      -  S  *  *  C  L  H  Y  G  Q  R  Y  R  F  W  R  H  L  T  L  Y
23641 - ACATGTAGACGCCTCTAAGATGACTTACACGATTAAACGAAGAGGTTATACCATCGAAAA - 23700
      -  T  C  R  R  L  *  D  D  L  H  D  *  T  K  R  L  Y  H  R  K
      -  H  V  D  A  S  K  M  T  Y  T  I  K  R  R  G  Y  T  I  E  N
      -  M  *  T  P  L  R  *  L  T  R  L  N  E  E  V  I  P  S  K  T
23701 - CGTGTGTTGATTTAGCACGTGAGAGTCCATAACGACGACTTGTCCTAGCGTTGTGTGCAC - 23760
      -  R  V  L  I  *  H  V  R  V  H  N  D  D  L  S  *  R  C  V  H
      -  V  C  *  F  S  T  *  E  S  I  T  T  T  C  P  S  V  V  C  T
      -  C  V  D  L  A  R  E  S  P  *  R  R  L  V  L  A  L  C  A  L
23761 - TTCACAAGCGAGTTCAGTTTGTTTACATGTTTTGGGGTTGAAACTTTATAAAACCACCAA - 23820
      -  F  T  S  E  F  S  L  F  T  C  F  G  V  E  T  L  *  N  H  Q
      -  S  Q  A  S  S  V  C  L  H  V  L  G  L  K  L  Y  K  T  T  K
      -  H  K  R  V  Q  F  V  Y  M  F  W  G  *  N  F  I  K  P  P  K
23821 - AATTAAAAAGTGTTTATAATGGACTGGGAGATTTCGGTTGATTCTCCAGAAAATAACTCC - 23880
      -  N  *  K  V  F  I  M  D  W  E  I  S  V  D  S  P  E  N  N  S
      -  I  K  K  C  L  *  W  T  G  R  F  R  L  I  L  Q  K  I  T  P
      -  L  K  S  V  Y  N  G  L  G  D  F  G  *  F  S  R  K  *  L  L
23881 - TGAACGAGAAATTATTCCACTGTGAGCGACTACGACCGAAGTACTTCGTTATACCGCTTA - 23940
      -  *  T  R  N  Y  S  T  V  S  D  Y  D  R  S  T  S  L  Y  R  L
      -  E  R  E  I  I  P  L  *  A  T  T  T  E  V  L  R  Y  T  A  Y
      -  N  E  K  L  F  H  C  E  R  L  R  P  K  Y  F  V  I  P  L  T
23941 - CGGATCCACTATAATTACGATCTCTAGAGTAAACACGCGTCTTCAAGTTACCTGAATGTC - 24000
      -  R  I  H  Y  N  Y  D  L  *  S  K  H  A  S  S  S  Y  L  N  V
      -  G  S  T  I  I  T  I  S  R  V  N  T  R  L  Q  V  T  *  M  S
      -  D  P  L  *  L  R  S  L  E  *  T  R  V  F  K  L  P  E  C  H
24001 - ACAACGGTGGAGACGAGTGACTACTATACTAACGACGGATGTGACGACGAGATCAATCAC - 24060
      -  T  T  V  E  T  S  D  Y  Y  T  N  D  G  C  D  D  E  I  N  H
      -  Q  R  W  R  R  V  T  T  I  L  T  T  D  V  T  T  R  S  I  T
      -  N  G  G  D  E  *  L  L  Y  *  R  R  M  *  R  R  D  Q  S  P
24061 - CATGACGGTGACGACCTACCTGTAAACCACGACCGCGACGAGAAGTTTATGGAAAACGAT - 24120
      -  H  D  G  D  D  L  P  V  N  H  D  R  D  E  K  F  M  E  N  D
      -  M  T  V  T  T  Y  L  *  T  T  T  A  T  R  S  L  W  K  T  I
      -  *  R  *  R  P  T  C  K  P  R  P  R  R  E  V  Y  G  K  R  Y
24121 - ACGTTTACCGTATATCCAAGTTACCGTAACCTCAATGGGTTTTACAAGAGATACTCTTGG - 24180
      -  T  F  T  V  Y  P  S  Y  R  N  L  N  G  F  Y  K  R  Y  S  W
      -  R  L  P  Y  I  Q  V  T  V  T  S  M  G  F  T  R  D  T  L  G
      -  V  Y  R  I  S  K  L  P  *  P  Q  W  V  L  Q  E  I  L  L  V
24181 - TTTTTGTTTAGCGGTTGGTTAAATTGTTCCGCTAATCAGTTTAAGTTCTTAGTGAATGTT - 24240
      -  F  L  F  S  G  W  L  N  C  S  A  N  Q  F  K  F  L  V  N  V
      -  F  C  L  A  V  G  *  I  V  P  L  I  S  L  S  S  *  *  M  L
      -  F  V  *  R  L  V  K  L  F  R  *  S  V  *  V  L  S  E  C  C
24241 - GTTGTAGTTGACGTAACCCGTTCGACGTTCTGCAACAATTGGTCTTACGAGTTCGTAATT - 24300
      -  V  V  V  D  V  T  R  S  T  F  C  N  N  W  S  Y  E  F  V  I
      -  L  *  L  T  *  P  V  R  R  S  A  T  I  G  L  T  S  S  *  F
      -  C  S  *  R  N  P  F  D  V  L  Q  Q  L  V  L  R  V  R  N  L
```

FIG. 5 Cont'd

```
24301 - TGTGTGAACAATTTGTTGAATCGAGATTAAAACCACGTTAAAGTTCACACGATTTACTAT - 24360
      - C  V  N  N  L  L  N  R  D  *  N  H  V  K  V  H  T  I  Y  Y
      -  V  *  T  I  C  *  I  E  I  K  T  T  L  K  F  T  R  F  T  I
      -   C  E  Q  F  V  E  S  R  L  K  P  R  *  S  S  H  D  L  L  *
24361 - AGGAAAGCGCTGAACTATTTCAGCTCCGCCTCCATGTTTAACTGTCCAATTAATGTCCGT - 24420
      - R  K  A  L  N  Y  F  S  S  A  S  M  F  N  C  P  I  N  V  R
      -  G  K  R  *  T  I  S  A  P  P  P  C  L  T  V  Q  L  M  S  V
      -   E  S  A  E  L  F  Q  L  R  L  H  V  *  L  S  N  *  C  P  S
24421 - CTGAAGTTTCGGAAGTTTGGATACATTGTGTTGTTGATTAGTCCCGACGACTTTAGTCCC - 24480
      - L  K  F  R  K  F  G  Y  I  V  L  L  I  S  P  D  D  F  S  P
      -  *  S  F  G  S  L  D  T  L  C  C  *  L  V  P  T  T  L  V  P
      -   E  V  S  E  V  W  I  H  C  V  V  D  *  S  R  R  L  *  S  R
24481 - GAAGACGATTAGAACGACGATGATTTTACAGACTCACACAAGAACCTGTTAGTTTTCTC - 24540
      - E  D  D  *  N  D  D  D  F  T  D  S  H  K  N  L  L  V  F  L
      -  K  T  I  R  T  T  M  I  L  Q  T  H  T  R  T  C  *  F  F  S
      -   R  R  L  E  R  R  *  F  Y  R  L  T  Q  E  P  V  S  F  S  Q
24541 - AACTGAAAACACCTTTCCCGATGGTGGAATACAGGAAGGGTGTTCGTCGGGCGTACCAC - 24600
      - N  *  K  H  L  S  R  W  W  N  T  G  R  V  F  V  G  A  Y  H
      -  T  E  N  T  F  P  D  G  G  I  Q  E  G  C  S  S  G  R  T  T
      -   L  K  T  P  F  P  M  V  E  Y  R  K  G  V  R  R  G  V  P  Q
24601 - AACAGAAGGATGTACAGTGCATACACGGTAGGGTCCTCTCCTTGAAGTGGTGTCGCGGTC - 24660
      - N  R  R  M  Y  S  A  Y  T  V  G  S  S  P  *  S  G  V  A  V
      -  T  E  G  C  T  V  H  T  R  *  G  P  L  L  E  V  V  S  R  S
      -   Q  K  D  V  Q  C  I  H  G  R  V  L  S  L  K  W  C  R  G  R
24661 - GTTAAACAGTACTTCCGTTTCGTATGAAGGGAGCACTTCCACAAAAACACAAATTACCGT - 24720
      - V  K  Q  Y  F  R  F  V  *  R  E  H  F  H  K  N  T  N  Y  R
      -  L  N  S  T  S  V  S  Y  E  G  S  T  S  T  K  T  Q  I  T  V
      -   *  T  V  L  P  F  R  M  K  G  A  L  P  Q  K  H  K  L  P  *
24721 - GAAGAACCAAATAATGTGTCTCCTTGAAGAAAAGAGGTGTTTATTAATGATGTCTGTTAT - 24780
      - E  E  P  N  N  V  S  P  *  R  K  E  V  F  I  N  D  V  C  Y
      -  K  N  Q  I  M  C  L  L  E  E  K  R  C  L  L  M  M  S  V  M
      -   R  T  K  *  C  V  S  L  K  K  R  G  V  Y  *  *  C  L  L  C
24781 - GTAAACAGAGTCCTTTAACACTACAGCAATAACCGTAGTAATTGTTGTGTCAAATACTAG - 24840
      - V  N  R  V  L  *  H  Y  S  N  N  R  S  N  C  C  V  K  Y  *
      -  *  T  E  S  F  N  T  T  A  I  T  V  V  I  V  V  S  N  T  R
      -   K  Q  S  P  L  T  L  Q  Q  *  P  *  *  L  L  C  Q  I  L  G
24841 - GAGACGTTGGACTCGAACTGAGTAAGTTTCTTCTCGACCTGTTCATGAAGTTTTTAGTAT - 24900
      - E  T  L  D  S  N  *  V  S  F  F  S  T  C  S  *  S  F  *  Y
      -  R  R  W  T  R  T  E  *  V  S  S  R  P  V  H  E  V  F  S  M
      -   D  V  G  L  E  L  S  K  F  L  L  D  L  F  M  K  F  L  V  C
24901 - GTAGTGGTCTACAACTAGAACCGCTGTAAAGTCCGTAATTGCGAAGACAGCAGTTGTAAG - 24960
      - V  V  V  Y  N  *  N  R  C  K  V  R  N  C  E  D  S  S  C  K
      -  *  W  S  T  T  R  T  A  V  K  S  V  I  A  K  T  A  V  V  S
      -   S  G  L  Q  L  E  P  L  *  S  P  *  L  R  R  Q  Q  L  *  V
24961 - TTTTTCTTTAACTGGCGGAGTTACTCCAGCGATTTTTAAATTTACTTAGTGAGTAACTGG - 25020
      - F  F  F  N  W  R  S  Y  S  S  D  F  *  I  Y  L  V  S  N  W
      -  F  S  L  T  G  G  V  T  P  A  I  F  K  F  T  *  *  V  T  G
      -   F  L  *  L  A  E  L  L  Q  R  F  L  N  L  L  S  E  *  L  E
25021 - AAGTTCTTAACCCTTTTATACTCGTTATATAATTTACCGGAACCATACAAACCGAGCCGA - 25080
      - K  F  L  T  L  L  Y  S  L  Y  N  L  P  E  P  Y  K  P  S  R
      -  S  S  *  P  F  Y  T  R  Y  I  I  Y  R  N  H  T  N  R  A  E
      -   V  L  N  P  F  I  L  V  I  *  F  T  G  T  I  Q  T  E  P  K
25081 - AGTAACGACCTGATTAACGGTAGCAGTACCAATGTTAGAACGAAACAACGTACTGATCAA - 25140
      - S  N  D  L  I  N  G  S  S  T  N  V  R  T  K  Q  R  T  D  Q
      -  V  T  T  *  L  T  V  A  V  P  M  L  E  R  N  N  V  L  I  N
      -   *  R  P  D  *  R  *  Q  Y  Q  C  *  N  E  T  T  Y  *  S  T
25141 - CAACGTCAACGGAGTTCCCACGTACGAGAACACCAAGAACGACGTTCAAACTACTCCTAC - 25200
      - Q  R  Q  R  S  S  H  V  R  E  H  Q  E  R  R  S  N  Y  S  Y
      -  N  V  N  G  V  P  T  Y  E  N  T  K  N  D  V  Q  T  T  P  T
      -   T  S  T  E  F  P  R  T  R  T  P  R  T  T  F  K  L  L  L  L
```

FIG. 5 Cont'd

```
25201 - TGAGACTCGGTCAAGAGTTCCCACAGTTTAATGTAATGTGTATTTGCTTGAATACCTAAA - 25260
      - *  D  S  V  K  S  S  H  S  L  M  *  C  V  F  A  *  I  P  K
      -  E  T  R  S  R  V  P  T  V  *  C  N  V  Y  L  L  E  Y  L  N
      -   R  L  G  Q  E  F  P  Q  F  N  V  M  C  I  C  L  N  T  *  T
25261 - CAAATACTCTAAAAAATGAGAACCTAGTTAATGACGTGTCGGTCATTTTTAACTGTTACG - 25320
      - Q  I  L  *  K  M  R  T  *  L  M  T  C  R  S  F  L  T  V  T
      -  K  Y  S  K  K  *  E  P  S  *  *  R  V  G  H  F  *  L  L  R
      -   N  T  L  K  N  E  N  L  V  N  D  V  S  V  I  F  N  C  Y  E
25321 - AAGAGGACGTTCATGACAAGTACGATGTCGTTGCTATGGCGATGTTCGGAGTGAGGGAAA - 25380
      - K  R  T  F  M  T  S  T  M  S  L  L  W  R  C  S  E  *  G  K
      -  R  G  R  S  *  Q  V  R  C  R  C  Y  G  D  V  R  S  E  G  K
      -   E  D  V  H  D  K  Y  D  V  V  A  M  A  M  F  G  V  R  E  S
25381 - GCCTACCGAACAATAACCGCAACGTAAAGAACGACAAAAAGTCTCGCGATGGTTTTATTA - 25440
      - A  Y  R  T  I  T  A  T  *  R  T  T  K  S  L  A  M  V  L  L
      -  P  T  E  Q  *  P  Q  R  K  E  R  Q  K  V  S  R  W  F  Y  *
      -   L  P  N  N  N  R  N  V  K  N  D  K  K  S  R  D  G  F  I  N
25441 - ACGCGAGTTATTTTCTACCGTCGATCGGGAAATATTCCCGAAGGTCAAGTAAACGTTAAA - 25500
      - T  R  V  I  F  Y  R  R  S  G  N  I  P  E  G  Q  V  N  V  K
      -  R  E  L  F  S  T  V  D  R  E  I  F  P  K  V  K  *  T  L  N
      -   A  S  Y  F  L  P  S  I  G  K  Y  S  R  R  S  S  K  R  *  M
25501 - TGACGACGATAAACAATGGTAGATAAGTGTAGAAAACGAACAGCGACGTCCATACCTCCG - 25560
      - *  R  R  *  T  M  V  D  K  C  R  K  R  T  A  T  S  I  P  P
      -  D  D  D  K  Q  W  *  I  S  V  E  N  E  Q  R  R  P  Y  L  R
      -   T  T  I  N  N  G  R  *  V  *  K  T  N  S  D  V  H  T  S  A
25561 - CGTTAAAAACATGGAGATACGGAACTATATAAAAGATGTTACGTAGTTGCGTACATCTTA - 25620
      - R  *  K  H  G  D  T  E  L  Y  K  R  C  Y  V  V  A  Y  I  L
      -  V  K  N  M  E  I  R  N  Y  I  K  D  V  T  *  L  R  T  S  *
      -   L  K  T  W  R  Y  G  T  I  *  K  M  L  R  S  C  V  H  L  N
25621 - ATAATACTCTACAACCGAAACAACCTTCACGTTTAGGTTCTTGGGTAATGAAATACTACG - 25680
      - I  I  L  Y  N  R  N  N  L  H  V  *  V  L  G  *  *  N  T  T
      -  *  Y  S  T  T  E  T  T  F  T  F  R  F  L  G  N  E  I  L  R
      -   N  T  L  Q  P  K  Q  P  S  R  L  G  S  W  V  M  K  Y  Y  G
25681 - GTTGATGAAACAAACGACCGTGTGTGTATTGATACTGATGACATATGGTATATTGTCACA - 25740
      - V  D  E  T  N  D  R  V  C  I  D  T  D  D  I  W  Y  I  V  T
      -  L  M  K  Q  T  T  V  C  V  L  I  L  M  T  Y  G  I  L  S  Q
      -   *  *  N  K  R  P  C  V  Y  *  Y  *  *  H  M  V  Y  C  H  S
25741 - GTGTCTATGTTAACAGCAATGACTTCCACTGCCGTAAAGTTGTGGTTTTGAGTTTCTTCT - 25800
      - V  S  M  L  T  A  M  T  S  T  A  V  K  L  W  F  *  V  S  S
      -  C  L  C  *  Q  Q  *  L  P  L  P  *  S  C  G  F  E  F  L  L
      -   V  Y  V  N  S  N  D  F  H  C  R  K  V  V  V  L  S  F  F  *
25801 - GATGGTTTAACCACCAATAAGACTCCTATCCGTGAGTCCACAATTTCTGATACAGCAACA - 25860
      - D  G  L  T  T  N  K  T  P  I  R  E  S  T  I  S  D  T  A  T
      -  M  V  *  P  P  I  R  L  L  S  V  S  P  Q  F  L  I  Q  Q  H
      -   W  F  N  H  Q  *  D  S  Y  P  *  V  H  N  F  *  Y  S  N  M
25861 - TGTACCGATAAAGTGGCTTCAAATGATGGTCGAACTCAGATGTGTTTAATGATGTCTGTG - 25920
      - C  T  D  K  V  A  S  N  D  G  R  T  Q  M  C  L  M  M  S  V
      -  V  P  I  K  W  L  Q  M  M  V  E  L  R  C  V  *  *  C  L  *
      -   Y  R  *  S  G  F  K  *  W  S  N  S  D  V  F  N  D  V  C  D
25921 - ACCATAACTTTTACGATGTAAGAAGTAGAAATTGTTCGAACAATTTCTGGGTGGCTTACA - 25980
      - T  I  T  F  T  M  *  E  V  E  I  V  R  T  I  S  G  W  L  T
      -  P  *  L  L  R  C  K  K  *  K  L  F  E  Q  F  L  G  G  L  H
      -   H  N  F  Y  D  V  R  S  R  N  C  S  N  N  F  W  V  A  Y  T
25981 - CGTTTATGTGTGTTAGCTGCCGAGAAGTCCTCAACGATTAGGTCGTTACCTAGGTTAAAT - 26040
      - R  L  C  V  L  A  A  E  K  S  S  T  I  R  S  L  P  R  L  N
      -  V  Y  V  C  *  L  P  R  S  P  Q  R  L  G  R  Y  L  G  *  I
      -   F  M  C  V  S  C  R  E  V  L  N  D  *  V  V  T  *  V  K  Y
26041 - ACTACTCGGCTGCTGCTGATGATCGCACGGAAACATTCGTGTTCTTTCACTCATGCTTGA - 26100
      - T  T  R  L  L  L  M  I  A  R  K  H  S  C  S  F  T  H  A  *
      -  L  L  G  C  C  *  *  S  H  G  N  I  R  V  L  S  L  M  L  E
      -   Y  S  A  A  A  D  D  R  T  E  T  F  V  F  F  H  S  C  L  N
```

FIG. 5 Cont'd

```
26101 - ATACATGAGTAAGCAAAGCCTTCTTTGTCCATGCAATTATCAATTATCGCATGAAGAAAA - 26160
       - I  H  E  *  A  K  P  S  L  S  M  Q  L  S  I  I  A  *  R  K
       - Y  M  S  K  Q  S  L  L  C  P  C  N  Y  Q  L  S  H  E  E  K
       - T  *  V  S  K  A  F  F  V  H  A  I  I  N  Y  R  M  K  K  K
26161 - AGAACGAAAGCACCATAAGAACGATCAGTGTGATCGGTAGGAATGACGCGAAGCTAACAC - 26220
       - R  T  K  A  P  *  E  R  S  V  *  S  V  G  M  T  R  S  *  H
       - E  R  K  H  H  K  N  D  Q  C  D  R  *  E  *  R  E  A  N  T
       - N  E  S  T  I  R  T  I  S  V  I  G  R  N  D  A  K  L  T  H
26221 - ACGCATGACGACGTTATAACAATTGCACTCAAATCATTTTGGTTGCCAAATGCAGATGAG - 26280
       - T  H  D  D  V  I  T  I  A  L  K  S  F  W  L  P  N  A  D  E
       - R  M  T  T  L  *  Q  L  H  S  N  H  F  G  C  Q  M  Q  M  S
       - A  *  R  R  Y  N  N  C  T  Q  I  I  L  V  A  K  C  R  *  A
26281 - CGCACAATTTTTAGACTTGAGAAGACTTCCTCAAGGACTAGAAGACCAGATTTGCTTGAT - 26340
       - R  T  I  F  R  L  E  K  T  S  S  R  T  R  R  P  D  L  L  D
       - A  Q  F  L  D  L  R  R  L  P  Q  G  L  E  D  Q  I  C  L  I
       - H  N  F  *  T  *  E  D  F  L  K  D  *  K  T  R  F  A  *  L
26341 - TGATAATAATAATAAGACAAACCTTGAAATTGTAACGAATAGTACCGTCTGTTGCCATGA - 26400
       - *  *  *  *  *  D  K  P  *  N  C  N  E  *  Y  R  L  L  P  *
       - D  N  N  N  K  T  N  L  E  I  V  T  N  S  T  V  C  C  H  D
       - I  I  I  I  R  Q  T  L  K  L  *  R  I  V  P  S  V  A  M  I
26401 - TAATGGCAACTCCTCGAATTTGTTGAGGACCTTGTTACCTTGGATCATTATCCAAAGGAT - 26460
       - *  W  Q  L  L  E  F  V  E  D  L  V  T  L  D  H  Y  P  K  D
       - N  G  N  S  S  N  L  L  R  T  L  L  P  W  I  I  I  Q  R  I
       - M  A  T  P  R  I  C  *  G  P  C  Y  L  G  S  L  S  K  G  *
26461 - AAGGATCGGACCTAATACAATGATGTTAAACGGATAAGATTAGCCTTGTCCAAAAACATG - 26520
       - K  D  R  T  *  Y  N  D  V  K  R  I  R  L  A  L  S  K  N  M
       - R  I  G  P  N  T  M  M  L  N  G  *  D  *  P  C  P  K  T  C
       - G  S  D  L  I  Q  *  C  *  T  D  K  I  S  L  V  Q  K  H  V
26521 - TATTATTTCGAACAAAAGGAGACCGAGAACACCGGTCATTGTGAACGAACAAAACACGAA - 26580
       - Y  Y  F  E  Q  K  E  T  E  N  T  G  H  C  E  R  T  K  H  E
       - I  I  S  N  K  R  R  P  R  T  P  V  I  V  N  E  Q  N  T  N
       - L  F  R  T  K  G  D  R  E  H  R  S  L  *  T  N  K  T  R  T
26581 - CGACGACAGATGTCTTAATTAACCCACTGACCGCCCTAACGCTAACGTTACCGAACATAA - 26640
       - R  R  Q  M  S  *  L  T  H  *  P  P  *  R  *  R  Y  R  T  *
       - D  D  R  C  L  N  *  P  T  D  R  P  N  A  N  V  T  E  H  N
       - T  T  D  V  L  I  N  P  L  T  A  L  T  L  T  L  P  N  I  T
26641 - CATCCGAACTACACCGAATCGATGAAGCAACGAAGGAAGTCCGACAAACGAGCATGGGCG - 26700
       - H  P  N  Y  T  E  S  M  K  Q  R  R  K  S  D  K  R  A  W  A
       - I  R  T  T  P  N  R  *  S  N  E  G  S  P  T  N  E  H  G  R
       - S  E  L  H  R  I  D  E  A  T  K  E  V  R  Q  T  S  M  G  E
26701 - AGTTACACCAGTAAGTTGGGTCTTTGTTTGTAAGAAGAGTTACACGGAGAGGCCCCCTGT - 26760
       - S  Y  T  S  K  L  G  L  C  L  *  E  E  L  H  G  E  A  P  C
       - V  T  P  V  S  W  V  F  V  C  K  K  S  Y  T  E  R  P  P  V
       - L  H  Q  *  V  G  S  L  F  V  R  R  V  T  R  R  G  P  L  L
26761 - TAACACTGGTCTGGCGAGTACCTTTCACTTGAACAGTAACCACGACACTAGTAAGCACCA - 26820
       - *  H  W  S  G  E  Y  L  S  L  E  Q  *  P  R  H  *  *  A  P
       - N  T  G  L  A  S  T  F  H  L  N  S  N  H  D  T  S  K  H  Q
       - T  L  V  W  R  V  P  F  T  *  T  V  T  T  T  L  V  S  T  S
26821 - GTGAACGCTTACCGGCCTGTGAGGGATCCCGCGACACTGTAATTCCTGGACGGTTTTCTC - 26880
       - V  N  A  Y  R  P  V  R  D  P  A  T  L  *  F  L  D  G  F  L
       - *  T  L  T  G  L  *  G  I  P  R  H  C  N  S  W  T  V  F  S
       - E  R  L  P  A  C  E  G  S  R  D  T  V  I  P  G  R  F  S  L
26881 - TAGTGACACCGATGTAGTGCTTGCGAAAGAATAATGTTTAATCCTCGCAGCGTCGCACAT - 26940
       - *  *  H  R  C  S  A  C  E  R  I  M  F  N  P  R  S  V  A  H
       - S  D  T  D  V  V  L  A  K  E  *  C  L  I  L  A  A  S  H  I
       - V  T  P  M  *  C  L  R  K  N  N  V  *  S  S  Q  R  R  T  S
26941 - CCGTGACTAAGTCCAAAACGACGTATGTTGGCGATGGCATAACCTTTGATATTTAATTTA - 27000
       - P  *  L  S  P  K  R  R  M  L  A  M  A  *  P  L  I  F  N  L
       - R  D  *  V  Q  N  D  V  C  W  R  W  H  N  L  *  Y  L  I  Y
       - V  T  K  S  K  T  T  Y  V  G  D  G  I  T  F  D  I  *  F  M
```

FIG. 5 Cont'd

```
27001 - TGTCTGGTGCGGCCATCGTTGCTGTTATAACGAAACGATCATGTCATTCACTGTTGTCTA - 27060
      - C  L  V  R  P  S  L  L  L  *  R  N  D  H  V  I  H  C  C  L
      - V  W  C  G  H  R  C  C  Y  N  E  T  I  M  S  F  T  V  V  Y
      - S  G  A  A  I  V  A  V  I  T  K  R  S  C  H  S  L  L  S  T
27061 - CAAAGTAGAACAACTGAAGGTCCAATGTTATCGTCTCTATAACTAATAGTAATACTCCTG - 27120
      - Q  S  R  T  T  E  G  P  M  L  S  S  L  *  L  I  V  I  L  L
      - K  V  E  Q  L  K  V  Q  C  Y  R  L  Y  N  *  *  *  Y  S  *
      - K  *  N  N  *  R  S  N  V  I  V  S  I  T  N  S  N  T  P  E
27121 - AAAGTCCTAACGATAAACCTTAGAACTGCAATATTATTCAAGTTATCACTCTGTTAATAA - 27180
      - K  V  L  T  I  N  L  R  T  A  I  L  F  K  L  S  L  C  *  *
      - K  S  *  R  *  T  L  E  L  Q  Y  Y  S  S  Y  H  S  V  N  K
      - S  P  N  D  K  P  *  N  C  N  I  I  Q  V  I  T  L  L  I  N
27181 - ATTCGGAGATTGATTCTTCTTAATAAGCCTCAATCTACTACTTCTTGGATACCTCAATCT - 27240
      - I  R  R  L  I  L  L  N  K  P  Q  S  T  T  S  W  I  P  Q  S
      - F  G  D  *  F  F  L  I  S  L  N  L  L  L  L  G  Y  L  N  L
      - S  E  I  D  S  S  *  *  A  S  I  Y  Y  F  L  D  T  S  I  *
27241 - AATAGGTATTTTGCTTGTACTTTTAATAAGAGAAGGACTGTAACTAACATAAATGTAGAA - 27300
      - N  R  Y  F  A  C  T  F  N  K  R  R  T  V  T  N  I  N  V  E
      - I  G  I  L  L  V  L  L  I  R  E  G  L  *  L  T  *  M  *  N
      - *  V  F  C  L  Y  F  *  *  E  K  D  C  N  *  H  K  C  R  T
27301 - CGCTCGATATAGTGATAGTCCTCACACAATCTCCATGCTGACATGATGATTTTCTTGGAA - 27360
      - R  S  I  *  *  *  S  S  H  N  L  H  A  D  M  M  I  F  L  E
      - A  R  Y  S  D  S  P  H  T  I  S  M  L  T  *  *  F  S  W  N
      - L  D  I  V  I  V  L  T  Q  S  P  C  *  H  D  D  F  L  G  T
27361 - CGGGTAGTCCTTGTATGCTCCCGTTAAGTGGTAAAGTGGGAGAACGACTGTTATTTAAAC - 27420
      - R  V  V  L  V  C  S  R  *  V  V  K  W  E  N  D  C  Y  L  N
      - G  *  S  L  Y  A  P  V  K  W  *  S  G  R  T  T  V  I  *  T
      - G  S  P  C  M  L  P  L  S  G  K  V  G  E  R  L  L  F  K  R
27421 - GTGATTAACGTGATCGTGTGTGAAACGAAAACGAACACGACTGCCATGAGCTGTATGGA - 27480
      - V  I  E  R  D  R  V  *  N  E  N  E  H  D  C  H  E  L  Y  G
      - *  L  N  V  I  V  C  E  T  K  T  N  T  T  A  M  S  C  M  D
      - D  *  T  *  S  C  V  K  R  K  R  T  R  L  P  *  A  V  W  I
27481 - TAGTCGACGCACGTTCTAGTCAAAGTGGTTTTGAAAAGTAGTCTGTTCTCCTCCAAGTTG - 27540
      - *  S  T  H  V  L  V  K  V  V  L  K  S  S  L  F  S  S  K  L
      - S  R  R  T  F  *  S  K  W  F  *  K  V  V  C  S  P  P  S  C
      - V  D  A  R  S  S  Q  S  G  F  E  K  *  S  V  L  L  Q  V  V
27541 - TTCTCGAGATGAGCGGTGAAAAAGAGTAACAACGACGAGATCATAAAAATTATGAAACGA - 27600
      - F  S  R  *  A  V  K  K  S  N  N  D  E  I  I  K  I  M  K  R
      - S  R  D  E  R  *  K  R  V  T  T  T  R  S  *  K  L  *  N  E
      - L  E  M  S  G  E  K  E  *  Q  R  R  D  H  K  N  Y  E  T  K
27601 - AGTGGTAATTCTCTTTCTGTCTTACTTACTCGAGTGAAATTAACTGAAGATAAACACGAA - 27660
      - S  G  N  S  L  S  V  L  L  T  R  V  K  L  T  E  D  K  H  E
      - V  V  I  L  F  L  S  Y  L  L  E  *  N  *  L  K  I  N  T  K
      - W  *  F  S  F  C  L  T  Y  S  S  E  I  N  *  R  *  T  R  K
27661 - AAATCGGAAAGACGATAAGGAACAAAATTATTACGAATAATATAAAACCAAAAGTGAGCT - 27720
      - K  S  E  R  R  *  G  T  K  L  L  R  I  I  *  N  Q  K  *  A
      - N  R  K  D  D  K  E  Q  N  Y  Y  E  *  Y  K  T  K  S  E  L
      - I  G  K  T  I  R  N  K  I  I  T  N  N  I  K  P  K  V  S  F
27721 - TTAGGTCCTAGATCTTCTTGGAACATGGTTTCAGATTTGCTTGTACTTTGAAGAGTAACA - 27780
      - L  G  P  R  S  S  W  N  M  V  S  D  L  L  V  L  *  R  V  T
      - *  V  L  D  L  L  G  T  W  F  Q  I  C  L  Y  F  E  E  *  Q
      - R  S  *  I  F  L  E  H  G  F  R  F  A  C  T  L  K  S  N  K
27781 - AAACTGAACATAAAGAGATACGTCAACGTATGCGTGACATCATGTCGCGACACGTAGATT - 27840
      - K  L  N  I  K  R  Y  V  N  V  C  V  T  S  C  R  D  T  *  I
      - N  *  T  *  R  D  T  S  T  Y  A  *  H  H  V  A  T  R  R  L
      - T  E  H  K  E  I  R  Q  R  M  R  D  I  M  S  R  H  V  D  Y
27841 - ATTTGGAGTACACGAACTTCTAGGAACATTCCATGTTGTGATCCCCATTATGAATATCGT - 27900
      - I  W  S  T  R  T  S  R  N  I  P  C  C  D  P  H  Y  E  Y  R
      - F  G  V  H  E  L  L  G  T  F  H  V  V  I  P  I  M  N  I  V
      - L  E  Y  T  N  F  *  E  H  S  M  L  *  S  P  L  *  I  S  *
```

FIG. 5 Cont'd

```
27901 - GACGAACCGAAACACGAGATCCTTTCCAAAATGGAAAAGTATCTACCGTGTGATACCAAG - 27960
       - D  E  P  K  H  E  I  L  S  K  M  E  K  Y  L  P  C  D  T  K
        - T  N  R  N  T  R  S  F  P  K  W  K  S  I  Y  R  V  I  P  S
         - R  T  E  T  R  D  P  F  Q  N  G  K  V  S  T  V  *  Y  Q  V
27961 - TTTGTACGTGTGGATTACAATGATAGTTGACAGTTCTAGGTCGACCACCACGCGAATATC - 28020
       - F  V  R  V  D  Y  N  D  S  *  Q  F  *  V  D  H  H  A  N  I
        - L  Y  V  W  I  T  M  I  V  D  S  S  R  S  T  T  T  R  I  S
         - C  T  C  G  L  Q  *  *  L  T  V  L  G  R  P  P  R  E  Y  R
28021 - GATCCACAACCATGGAAGTACTTCCAGTGGTTTGACGACGTAAATCTCTGCATGAACAAC - 28080
       - D  P  Q  P  W  K  Y  F  Q  W  F  D  D  V  N  L  C  M  N  N
        - I  H  N  H  G  S  T  S  S  G  L  T  T  *  I  S  A  *  T  T
         - S  T  T  M  E  V  L  P  V  V  *  R  R  K  S  L  H  E  Q  Q
28081 - AAAATTTATTTGCTTGTTTAATTTTACAGACTATTACCTGGGGTTAGTTTGGTTGCATCA - 28140
       - K  I  Y  L  L  V  *  F  Y  R  L  L  P  G  V  S  L  V  A  S
        - K  F  I  C  L  F  N  F  T  D  Y  Y  L  G  L  V  W  L  H  H
         - N  L  F  A  C  L  I  L  Q  T  I  T  W  G  *  F  G  C  I  T
28141 - CGGGGGGCGTAATGTAAACCACCTGGGTGTCTAAGTTGACTGTTATTGGTCTTACCTCCT - 28200
       - R  G  A  *  C  K  P  P  G  C  L  S  *  L  L  L  V  L  P  P
        - G  G  R  N  V  N  H  L  G  V  *  V  D  C  Y  W  S  Y  L  L
         - G  G  V  M  *  T  T  W  V  S  K  L  T  V  I  G  L  T  S  C
28201 - GCGTTACCCCGTTCCGGTTTTGTCGCGGCTGGGGTTCCAAATGGGTTATTATGACGCAGA - 28260
       - A  L  P  R  S  G  F  V  A  A  G  V  P  N  G  L  L  *  R  R
        - R  Y  P  V  P  V  L  S  R  L  G  F  Q  M  G  Y  Y  D  A  E
         - V  T  P  F  R  F  C  R  G  W  G  S  K  W  V  I  M  T  Q  N
28261 - ACCAAGTGTCGAGAGTGAGTCGTACCGTTCCTCCTTGAATCTAAGGGAGCTCCGGTCCCG - 28320
       - T  K  C  R  E  *  V  V  P  F  L  L  E  S  K  G  A  P  V  P
        - P  S  V  E  S  E  S  Y  R  S  S  L  N  L  R  E  L  R  S  R
         - Q  V  S  R  V  S  R  T  V  P  P  *  I  *  G  S  S  G  P  A
28321 - CAAGGTTAGTTGTGGTTATCACCAGGTCTACTGGTTTAACCGATGATGGCTTCTCGATGG - 28380
       - Q  G  *  L  W  L  S  P  G  L  L  V  *  P  M  M  A  S  R  W
        - K  V  S  C  G  Y  H  Q  V  Y  W  F  N  R  *  W  L  L  D  G
         - R  L  V  V  V  I  T  R  S  T  G  L  T  D  D  G  F  S  M  G
28381 - GCTGCTCAAGCACCACCACTGCCGTTTTACTTTCTCGAGTCGGGGTCTACCATGAAGATA - 28440
       - A  A  Q  A  P  P  L  P  F  Y  F  L  E  S  G  S  T  M  K  I
        - L  L  K  H  H  H  C  R  F  T  F  S  S  R  G  L  P  *  R  *
         - C  S  S  T  T  T  A  V  L  L  S  R  V  G  V  Y  H  E  D  N
28441 - ATGGATCCTTGACCGGGTCTTCGAAGTGAAGGGATGCCGCGATTGTTTCTTCCGTAGCAT - 28500
       - M  D  P  *  P  G  L  R  S  E  G  M  P  R  L  F  L  P  *  H
        - W  I  L  D  R  V  F  E  V  K  G  C  R  D  C  F  F  R  S  I
         - G  S  L  T  G  S  S  K  *  R  D  A  A  I  V  S  S  V  A  Y
28501 - ACCCAACGTTGACTCCCTCGGAACTTATGTGGGTTTCTGGTGTAACCGTGGGCGTTAGGA - 28560
       - T  Q  R  *  L  P  R  N  L  C  G  F  L  V  *  P  W  A  L  G
        - P  N  V  D  S  L  G  T  Y  V  G  F  W  C  N  R  G  R  *  D
         - P  T  L  T  P  S  E  L  M  W  V  S  G  V  T  V  G  V  R  I
28561 - TTATTGTTACGACGGTGGCACGATGTTGAAGGAGTTCCTTGTTGTAACGGTTTTCCGAAG - 28620
       - L  L  L  R  R  W  H  D  V  E  G  V  P  C  C  N  G  F  P  K
        - Y  C  Y  D  G  G  T  M  L  K  E  F  L  V  V  T  V  F  R  R
         - I  V  T  T  V  A  R  C  *  R  S  S  L  L  *  R  F  S  E  D
28621 - ATGCGTCTCCCTTCGTCTCCGCCGTCAGTTCGGAGAAGAGCGAGGAGTAGTGCATCAGCG - 28680
       - M  R  L  P  S  S  P  S  V  R  R  R  A  R  S  S  A  S  A
        - C  V  S  L  R  L  R  R  Q  F  G  E  E  R  G  V  V  H  Q  R
         - A  S  P  F  V  S  A  V  S  S  E  K  S  E  E  *  C  I  S  A
28681 - CCATTAAGTTCTTTAAGTTGAGGACCGTCGTCATCCCCTTTAAGAGGACGAGCTTACCGA - 28740
       - P  L  S  S  L  S  *  G  P  S  S  S  P  L  R  G  R  A  Y  R
        - H  *  V  L  *  V  E  D  R  R  H  P  L  *  E  D  E  L  T  D
         - I  K  F  F  K  L  R  T  V  V  I  P  F  K  R  T  S  L  P  I
28741 - TCGCCTCCACCACTTTGACGGGAGCGCGATAACGACGATCTGTCTAACTTGGTCGAACTC - 28800
       - S  P  P  P  L  *  R  E  R  D  N  D  D  L  S  N  L  V  E  L
        - R  L  H  H  F  D  G  S  A  I  T  T  I  C  L  T  W  S  N  S
         - A  S  T  T  L  T  G  A  R  *  R  R  S  V  *  L  G  R  T  L
```

FIG. 5 Cont'd

```
28801 - TCGTTTCAAAGACCATTTCCGGTTGTTGTTGTTCCGGTTTGACAGTGATTCTTTAGACGA - 28860
       - S F Q R P F P V V V V P V * Q * F F R R
       - R F K D H F R L L L F R F D S D S L D D
       - V S K T I S G C C C S G L T V I L * T T
28861 - CGACTCCGTAGATTTTTCGGAGCGGTTTTTGCATGACGGTGTTTTGTCATGTTGCAGTGA - 28920
       - R L R R F F G A V F A * R C F V M L Q *
       - D S V D F S E R F L H D G V L S C C S E
       - T P * I F R S G F C M T V F C H V A V S
28921 - GTTCGTAAACCCTCTGCACCAGGTCTTGTTTGGGTTCCTTTAAAGCCCCTGGTTCTGGAT - 28980
       - V R K P S A P G L V W V P L K P L V L D
       - F V N P L H Q V L F G F L * S P W F W I
       - S * T L C T R S C L G S F K A P G S G L
28981 - TAGTCTGTTCCTTGACTAATGTTTGTAACCGGCGTTTAACGTGTTAAACGAGGTTCACGG - 29040
       - * S V P * L M F V T G V * R V K R G S R
       - S L F L D * C L * P A F N V L N E V H G
       - V C S L T N V C N R R L T C * T R F T E
29041 - AGACGTAAGAAACCTTACAGTGCGTAACCGTACCTTCAGTGTGGAAGCCCTTGTACCGAC - 29100
       - R R K K P Y S A * P Y L Q C G S P C T D
       - D V R N L T V R N R T F S V E A L V P T
       - T * E T L Q C V T V P S V W K P L Y R L
29101 - TGAATAGTACCTCGGTAATTTAACCTACTGTTTCTAGGTGTTAAGTTTCTGTTGCAGTAT - 29160
       - * I V P R * F N L L F L G V K F L L Q Y
       - E * Y L G N L T Y C F * V L S F C C S M
       - N S T S V I * P T V S R C * V S V A V *
29161 - GACGACTTGTTCGTGTAACTGCGTATGTTTTGTAAGGGTGGTTGTCTCGGATTTTTCCTG - 29220
       - D D L F V * L R M F C K G G C L G F F L
       - T T C S C N C V C F V R V V V S D F S C
       - R L V R V T A Y V L * G W L S R I F P V
29221 - TTTTTCTTTTTCTGACTACTTCGAGTCGGAAACGGCGTCTCTGTTTTCTTCGTCGGGTGA - 29280
       - F F F F * L L R V G N G V S V F F V G *
       - F S F S D Y F E S E T A S L F S S S G D
       - F L F L T T S S R K R R L C F L R R V T
29281 - CACTGAGAAGAAGGACGCCGACTGTACCTACTAAAGAGGTCTGTTGAAGTTTTAAGGTAC - 29340
       - H * E E G R R L Y L L K R S V E V L R Y
       - T E K K D A D C T Y * R G L L K F * G T
       - L R R R T P T V P T K E V C * S F K V L
29341 - TCACCTCGAAGACGACTAAGTTGAGTCCGTATTTGTGAGTACTACTGGTGTGTTCCGTCT - 29400
       - S P R R R L S * V R I C E Y Y W C V P S
       - H L E D D * V E S V F V S T T G V F R L
       - T S K T T K L S P Y L * V L L V C S V Y
29401 - ACCCGATACATTTGCAAAAGCGTTAAGGCAAATGCTATGTATCAGATGAGAACACGTCTT - 29460
       - T R Y I C K S V K A N A M Y Q M R T R L
       - P D T F A K A L R Q M L C I R * E H V L
       - P I H L Q K R * G K C Y V S D E N T S Y
29461 - ACTTAAGAGCATTGATTTGTCGTGTTCATCCAAATCAATTGAAATTAGAGTGTATCGTTA - 29520
       - T * E H * F V V F I Q I N * N * S V S L
       - L K S I D L S C S S K S I E I R V Y R *
       - L R A L I C R V H P N Q L K L E C I V R
29521 - GAAATTAGTTACACATTGTAATCCCTCCTGAACTTTCTCGGTGGTGTAAAAGTAGCTCCG - 29580
       - E I S Y T L * S L L N F L G G V K V A P
       - K L V T H C N P S * T F S V V * K * L R
       - N * L H I V I P P E L S R W C K S S S G
29581 - GTGCGCCTCATGCTAGCTCCCATGTCACTTATTACGATCCCTCTCGACGGATATACCTTC - 29640
       - V R L M L A P M S L I T I P L D G Y T F
       - C A S C * L P C H L L R S L S T D I P S
       - A P H A S S H V T Y Y D P S R R I Y L L
29641 - TCGGGATTACACATTTTAATTAAAATCATCACGATAGGGGTACACTAAAATTATCGAAGA - 29700
       - S G L H I L I K I I T I G V H * N Y R R
       - R D Y T F * L K S S R * G Y T K I I E E
       - G I T H F N * N H H D R G T L K L S K N
```

FIG. 5 Cont'd

```
29701 - ATCCTCTTACTGTTTTTTTTTTTTTTTTTTTTTTTT - 29736
       - I  L  L  L  F  F  F  F  F  F  F  F  X
       - S  S  Y  C  F  F  F  F  F  F  F  X
       -    P  L  T  V  F  F  F  F  F  F  X
```

FIG. 5 Cont'd

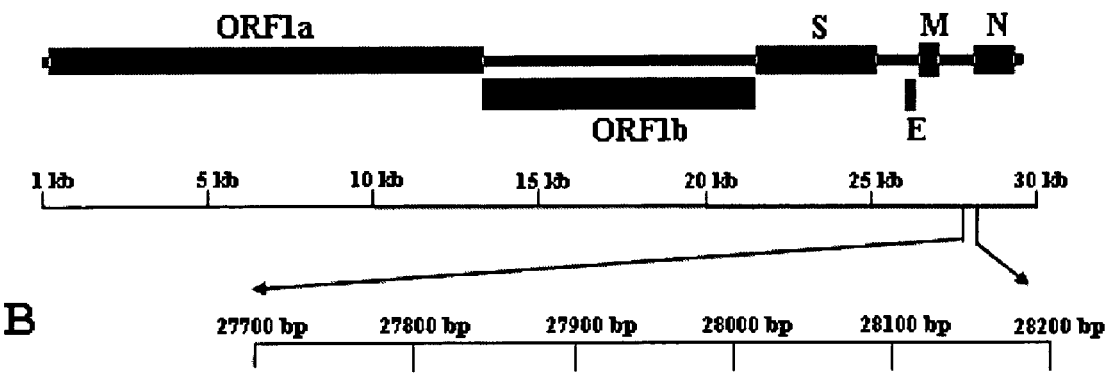
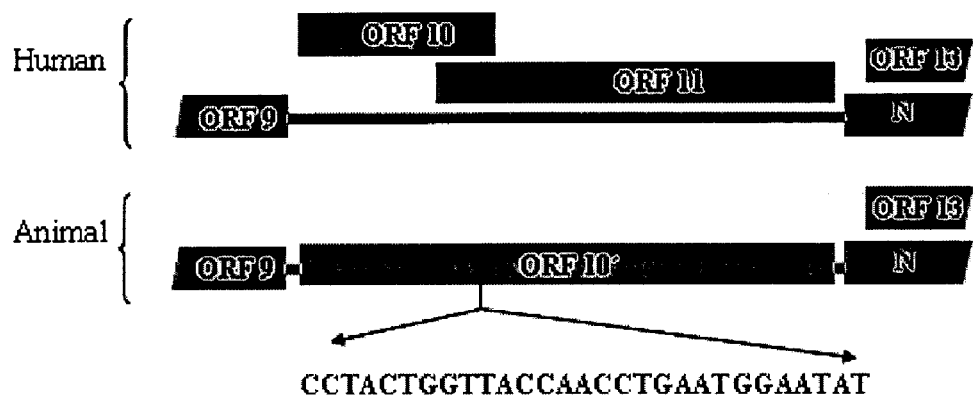

CCTACTGGTTACCAACCTGAATGGAATAT

```
         1                                                      50
ORF10   MKLLIVLTCI SLCSCICTVV QRCASNKPHV LEDPCKVQH~ ~~~~~~~~~~
ORF11   ~~~~~~~~~~ ~~~~~~~~~~ ~~~~~~~~~~ ~~~~~~~~MC LKILVRYNTR
ORF10'  MKLLIVLTCI SLCSCICTVV QRCASNKPHV LEDPCPTGYQ PEWNIRYNTR 51                                                    100
ORF10   ~~~~~~~~~~ ~~~~~~~~~~ ~~~~~~~~~~ ~~~~~~~~~~ ~~~~~~~~~~
ORF11   GNTYSTAWLC ALGKVLPFHR WHTMVQTCTP NVTINCQDPA GGALIARCWY
ORF10'  GNTYSTAWLC ALGKVLPFHR WHTMVQTCTP NVTINCQDPA GGALIARCWY 101        122
ORF10   ~~~~~~~~~~ ~~~~~~~~~~ ~~         SEQ ID NO:8
ORF11   LHEGHQTAAF RDVLVVLNKR TN         SEQ ID NO:9
ORF10'  LHEGHQTAAF RDVLVVLNKR TN         SEQ ID NO:3
```

FIG. 6

| | | | | | | | | | | | | | | | |
|---|---|---|---|---|---|---|---|---|---|---|---|---|---|---|---|
| 1 | ATG | AAA | CTT | CTC | ATT | GTT | TTG | ACT | TGT | ATT | TCT | CTA | TGC | AGT | TGC | 45 |
| 1 | M | K | L | L | I | V | L | T | C | I | S | L | C | S | C | 15 |
| 46 | ATA | CGC | ACT | GTA | GTA | CAG | CGC | TGT | GCA | TCT | AAT | AAA | CCT | CAT | GTG | 90 |
| 16 | I | R | T | V | V | Q | R | C | A | S | N | K | P | H | V | 30 |
| 91 | CTT | GAA | GAT | CCT | TGT | CCT | ACT | GGT | TAC | CAA | CCT | GAA | TGG | AAT | ATA | 135 |
| 31 | L | E | D | P | C | P | T | G | Y | Q | P | E | W | N | I | 45 |
| 136 | AGG | TAC | AAC | ACT | AGG | GGT | AAT | ACT | TAT | AGC | ACT | GCT | TGG | CTT | TGT | 180 |
| 46 | R | Y | N | T | R | G | N | T | Y | S | T | A | W | L | C | 60 |
| 181 | GCT | CTA | GGA | AAG | GTT | TTA | CCT | TTT | CAT | AGA | TGG | CAC | ACT | ATG | GTT | 225 |
| 61 | A | L | G | K | V | L | P | F | H | R | W | H | T | M | V | 75 |
| 226 | CAA | ACA | TGC | ACA | CCT | AAT | GTT | ACT | ATC | AAC | TGT | CAA | GAT | CCA | GCT | 270 |
| 76 | Q | T | C | T | P | N | V | T | I | N | C | Q | D | P | A | 90 |
| 271 | GGT | GGT | GCG | CTT | ATA | GCT | AGG | TGT | TGG | TAC | CTT | CAT | GAA | GGT | CAC | 315 |
| 91 | G | G | A | L | I | A | R | C | W | Y | L | H | E | G | H | 105 |
| 316 | CAA | ACT | GCT | GCA | TTT | AGA | GAC | GTA | CTT | GTT | GTT | TTA | ACT | AAA | CGA | 360 |
| 106 | Q | T | A | A | F | R | D | V | L | V | V | L | T | K | R | 120 |
| 361 | ACA | AAT | TAA | 369 | | | | | | | | | | | | |
| 121 | T | N | * | | | | | | | | | | | | | |

FIG. 7

ISOLATION AND CHARACTERIZATION OF THE PRECURSOR VIRUS OF HUMAN SARS VIRUS: SARS-ASSOCIATED CORONA VIRUS-LIKE VIRUS

This application claims priority benefit to U.S. provisional application No. 60/473,255 filed May 22, 2003, which is incorporated herein by reference in its entirety.

The instant application contains a lengthy Sequence Listing which is being concurrently submitted via triplicate CD-R in lieu of a printed paper copy, and is hereby incorporated by reference in its entirety. Said CD-R, recorded on May 24, 2004, are labeled "CRF", "Copy 1" and "Copy 2", respectively, and each contains only one identical 1.56 Mb file (V9661081.APP).

1. INTRODUCTION

The present invention relates to isolation and characterization of a class of isolated novel viruses which is the precursor of the virus causing Severe Acute Respiratory Syndrome (SARS) in humans ("hSARS virus"). The precursor virus which is a SARS coronavirus-like virus ("SCoV-like virus") is identified to be morphologically and phylogenetically similar to hSARS virus. The present invention relates to a nucleotide sequence comprising the genomic sequence of the SCoV-like virus. The invention further relates to nucleotide sequences comprising a portion of the genomic sequence of the SCoV-like virus. The invention also relates to the deduced amino acid sequences of the SCoV-like virus. The invention further relates to the nucleic acids and peptides encoded by and/or derived from these sequences and their use in diagnostic methods and therapeutic methods. The invention further encompasses chimeric or recombinant viruses encoded by said nucleotide sequences and antibodies directed against polypeptides encoded by the nucleotide sequences. Furthermore, the invention relates to vaccine preparations comprising the SCoV-like virus, including recombinant and chimeric forms of said virus.

2. BACKGROUND OF THE INVENTION

Recently, there has been an outbreak of a typical pneumonia in Guangdong province in mainland China. Between November 2002 and March 2003, there were 792 reported cases with 31 fatalities (WHO. Severe Acute Respiratory Syndrome (SARS) *Weekly Epidemiol Rec.* 2003; 78: 86). In response to this crisis, the Hospital Authority in Hong Kong has increased the surveillance on patients with severe atypical pneumonia. In the course of this investigation, a number of clusters of health care workers with the disease were identified. In addition, there were clusters of pneumonia incidents among persons in close contact with those infected. The disease was unusual in its severity and its progression in spite of the antibiotic treatment typical for the bacterial pathogens that are known to be commonly associated with atypical pneumonia. The disease was given the acronym Severe Acute Respiratory Syndrome ("SARS"). The virus was isolated from the patients suffering from SARS in the recent outbreak of severe atypical pneumonia in China. The isolated virus is an enveloped, single-stranded RNA virus of positive polarity which belongs to the order, Nidovirales, of the family, Coronaviridae. The hSARS virus was deposited with China Center for Type Culture Collection (CCTCC) on Apr. 2, 2003 and accorded an accession number, CCTCC-V200303, which is incorporated by reference in its entirety.

The etiologic agent responsible for this disease is a novel coronavirus known as hSARS virus. The viral genome sequence taken together with the epidemiological evidence suggest that the SARS associated coronavirus (SCoV) crossed the species barrier from animals to humans in the recent past.

3. SUMMARY OF INVENTION

The present invention is based upon the inventors' isolation and identification of a class of novel viruses which is the precursor of the virus causing Severe Acute Respiratory Syndrome in humans ("hSARS virus"). The precursor virus which is a SARS coronavirus-like virus ("SCoV-like virus") is identified to be morphologically and phylogenetically similar to hSARS virus.

An investigation was carried out in a retail live animal market in Guangdong, mainland China, the hypothetical birthplace of SARS, to better understand the animal reservoir of this virus. SCoV-like viruses were isolated from 4 of 6 Himalayan palm civets (*Paguma larvata*, Family Viverridae) and the serum from three of these animals neutralized the virus. Evidence of virus infection was also detected in a raccoon dog (*Nyctereutes procyonoides*) and Chinese ferret badger (*Melogale moschata*). Phylogenetic analysis indicates that these animal viruses have an ancestral relationship with the human SCoV with which they share genetic similarity. Sequence analysis revealed that all the animal virus isolates retain an "additional" 29 nucleotide sequence (SEQ ID NO:1) which is not found in most human virus isolates which results in the nucleotide sequence of SEQ ID NO:2 encoding a new putative protein of 122 amino acids (SEQ ID NO:3). The detection of SCoV-like viruses in small wild mammals found in live retail markets supplying the restaurant trade in Guangdong indicates how this virus may have crossed from its animal reservoir to humans. These findings are important for public health and may provide clues to understanding the inter-species transmission events relevant to the genesis of novel emerging diseases.

Accordingly, the present invention relates to a nucleotide sequence comprising the genomic sequence of the SCoV-like virus. The invention further relates to nucleotide sequences comprising a portion of the genomic sequence of the SCoV-like virus. The invention also relates to the deduced amino acid sequences of the SCoV-like virus. In specific embodiments, the invention provides a virus comprising a nucleic acid sequence of SEQ ID NO:1 or 2. In specific embodiments, the invention provides a virus comprising a nucleic acid sequence that encodes a polypeptide having an amino acid sequence of SEQ ID NO:3. The invention further relates to the nucleic acids and peptides encoded by and/or derived from these sequences. In a specific embodiment, the invention provides the isolated SCoV-like virus that morphologically and phylogenetically relates to hSARS virus and comprises the nucleotide sequence of SEQ ID NO:1 in its genome. In a preferred embodiment, the virus comprises a nucleotide sequence of SEQ ID NO:1, a portion thereof, a complement thereof, or that hybridizes to the complement of SEQ ID NO:1. In another specific embodiment, the virus preferably further comprises a nucleotide sequence of SEQ ID NO: 2, a portion thereof, a complement thereof, or portions that hybridizes to the complement of SEQ ID NO:2, in its genome. In a specific embodiment, the present invention provides isolated nucleic acid molecules comprising or, alternatively, consisting of the nucleotide sequence of SEQ ID NO:1, a complement thereof or a portion thereof, preferably at least 3, 4, 5, 6, 7, 8, 9, 10, 11, 12, 13, 14, 15, 16, 17, 18, 19, 20, 21, 22, 23, 24, 25, 26, 27, or 28 nucleotides of the nucleic acid sequence of SEQ ID NO:1. In another specific embodiment, the invention provides isolated nucleic acid molecules comprising or, alternatively, consisting of the nucleotide sequence of SEQ ID NO:2, a complement there of, or portions thereof, preferably at least, 5, 10, 15, 20, 25, 30, 35, 40, 45, 50, 60, 70, 80, 90, 100, 120, 140, 160, 180, 200, 220, 240, 260, 280, 300, 320, 340, 360, or more contiguous nucleotides of the nucleotide sequence of SEQ ID NO:2. In yet another specific embodiment, the present invention provides isolated nucleic acid molecules further comprising or, alternatively, consisting of the nucleotide sequence of SEQ ID NO:4, a complement thereof or a portion thereof, preferably at least 5, 10, 15, 20, 25, 30, 35, 40, 45, 50, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000, or more contiguous nucleotides of the nucleotide sequence of SEQ ID NO:4, or a complement thereof. Furthermore, in another specific embodiment, the invention provides isolated nucleic acid molecules comprising SEQ ID NO:1 and a sequence which hybridizes under stringent conditions, as defined herein, to a nucleic acid molecule having the sequence of SEQ ID NO:4, or a complement, or a portion thereof. In one embodiment, the invention provides an isolated nucleic acid molecule which is antisense to the coding strand of a nucleic acid of the invention. In another specific embodiment, the invention provides isolated polypeptides or proteins that are encoded by a nucleic acid molecule comprising or, alternatively consisting of a nucleotide sequence that is at least 5, 10, 15, 20, 25, or 28 contiguous nucleotides of the nucleotide sequence of SEQ ID NO:1, or a complement thereof. In yet another specific embodiment, the invention provides isolated polypeptides or proteins that are encoded by a nucleic acid molecule comprising or, alternatively consisting of nucleotide sequence that is at least 5, 10, 15, 20, 25, 30, 35, 40, 45, 50, 60, 70, 80, 90, 100, 120, 140, 160, 180, 200, 220, 240, 260, 280, 300, 320, 340, 360, or more contiguous nucleotides of the nucleotide sequence of SEQ ID NO:2, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 50, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:4, or a complement thereof (SEQ ID NO:1102).

The invention further provides proteins or polypeptides that are isolated from the SCoV-like virus, including viral proteins isolated from cells infected with the virus but not present in comparable uninfected cells. In a specific embodiment, the polypeptide comprises the sequence of SEQ ID NO:3. The invention further provides proteins or polypeptides shown in FIG. 4 (SEQ ID NOS:12-233, 235-729 and 731-1101), 5 (SEQ ID NOS:12-233, 235-729 and 731-1101), and 7 (SEQ ID NO:3). The polypeptides or the proteins of the present invention preferably having a biological activity of the protein (including antigenicity and/or immunogenicity) encoded by the sequence of SEQ ID NO:1, 2, a portion thereof, or their complements. In other embodiments, the polypeptides or the proteins of the present invention have a biological activity of the protein (including antigenicity and/or immunogenicity) encoded by a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:4, or a complement thereof (SEQ ID NO:1102).

In one aspect, the invention provides a method for propagating the SCoV-like virus in host cells comprising infecting the host cells with the isolated SCoV-like virus, culturing the host cells to allow the virus to multiply, and harvesting the resulting virions. Also provided by the present invention are host cells that are infected with the SCoV-like virus. In specific embodiments, the host cells are from animals for example, but not limited to, feline, canine, palm civet, raccoon-dog, or ferret badger. In another aspect, the invention relates to the use of the isolated SCo-V-like virus for diagnostic and therapeutic methods. In a specific embodiment, the invention provides a method of detecting in a biological sample an antibody immunospecific for the SCoV-like virus using the isolated SCoV-like virus or any proteins or polypeptides thereof. In another specific embodiment, the invention provides a method of screening for an antibody which immunospecifically binds and neutralizes SCoV-like viruses. Such an antibody is useful for a passive immunization or immunotherapy of a subject infected with a SCoV-like virus.

The invention further relates to the use of the sequence information of the isolated virus for diagnostic and therapeutic methods. In a specific embodiment, the invention provides nucleic acid molecules which are suitable for use as primers consisting of or comprising the nucleotide sequence of SEQ ID NO:1, 2, 4, or a complement thereof, or at least a portion of the nucleotide sequence thereof. In another specific embodiment, the invention provides nucleic acid molecules which are suitable for hybridization to SCoV-like viral nucleic acid, including, but not limited to, as PCR primers, Reverse Transcriptase primers, probes for Southern analysis or other nucleic acid hybridization analysis for the detection of SCo-V-like nucleic acids, e.g., consisting of or comprising the nucleotide sequence of SEQ ID NO:1, 2, 4, or a complement thereof, or a portion thereof. The invention further encompasses chimeric or recombinant viruses encoded in whole or in part by said nucleotide sequences.

The invention further provides antibodies that specifically bind a polypeptide of the invention encoded by the nucleotide sequence of SEQ ID NO:1, 2, 4, or a fragment thereof, or encoded by a nucleic acid comprising a nucleotide sequence that hybridizes under stringent conditions to the nucleotide sequence of SEQ ID NO:1, 2, or 4, and/or any SCoV-like viral epitope, having one or more biological activities of a polypeptide of the invention. These polypeptides include those shown in FIG. 4 (SEQ ID NOS:12-233, 235-729 and 731-1101), 5 (SEQ ID NOS:1103-1583, 1585-1958 and 1960-2464), and 7 (SEQ ID NO:3). The invention further provides antibodies that specifically bind polypeptides of the invention encoded by a nucleic acid comprising a nucleotide sequence that hybridizes under stringent conditions to the nucleotide sequence of SEQ ID NO:1, 2, or 4, and/or any SCoV-like viral epitope, having one or more biological activities of a polypeptide of the invention. Such antibodies include, but are not limited to polyclonal, monoclonal, bi-specific, multi-specific, human, humanized, chimeric antibodies, single chain antibodies, Fab fragments, F(ab')$_2$ fragments, disulfide-linked Fvs, intrabodies and fragments containing either a VL or VH domain or even a complementary determining region (CDR) that specifically binds to a polypeptide of the invention.

In one embodiment, the invention provides methods for detecting the presence, activity or expression of the SCoV-like virus of the invention in a biological material, such as cells, blood, sputum, stool, saliva, urine, and so forth. The increased or decreased activity or expression of the SCoV-like virus in a sample relative to a control sample can be determined by contacting the biological material with an agent which can detect directly or indirectly the presence, activity or expression of the SCoV-like virus. In a specific embodiment, the detecting agents are the antibodies or nucleic acid molecules of the present invention.

In another embodiment, the invention provides vaccine preparations, comprising the SCoV-like virus, including recombinant and chimeric forms of said virus, or protein subunits of the virus. In a specific embodiment, the vaccine preparations of the present invention comprise live but attenuated SCoV-like virus with or without adjuvants. In another specific embodiment, the vaccine preparations of the invention comprise an inactivated or killed SCoV-like virus. Such attenuated or inactivated viruses may be prepared by a series of passages of the virus through the host cells or by preparing recombinant or chimeric forms of virus. Accordingly, the present invention further provides methods of preparing recombinant or chimeric forms of SCoV-like virus. In another specific invention, the vaccine preparations of the present invention comprise a nucleic acid or fragment of the SCoV-like virus, e.g., the virus having nucleic acid molecules having the sequence of SEQ ID NO. 1, 2, 4, or a fragment thereof, or a complement thereof. In another embodiment, the invention provides vaccine preparations comprising one or more polypeptides isolated from or produced from nucleic acid of SCoV-like virus. In a specific embodiment, the vaccine preparations comprise a polypeptide of the invention encoded by the nucleotide sequence of SEQ ID NO:1, 2, 4, or a fragment thereof. In a specific embodiment, the vaccine preparations comprise polypeptides of the invention as shown in FIG. 4 (SEQ ID NOS: 12-233, 235-729 and 731-1101), 5 (SEQ ID NOS:1103-1583, 1585-1958 and 1960-2464), or 7 (SEQ ID NO:3).

In another aspect, the present invention provides pharmaceutical compositions comprising anti-viral agents of the present invention and a pharmaceutically acceptable carrier. In a specific embodiment, the anti-viral agent of the invention is an antibody that immunospecifically binds SCoV-like virus or any SCoV-like viral epitope. In another specific embodiment, the anti-viral agent is a polypeptide or protein of the present invention or nucleic acid molecule of the invention. The invention also provides kits containing a pharmaceutical composition of the present invention.

3.1 Definitions

The term "an antibody or an antibody fragment that immunospecifically binds a polypeptide of the invention" as used herein refers to an antibody or a fragment thereof that immunospecifically binds to the polypeptide encoded by the nucleotide sequence of the invention, or a fragment thereof, and does not non-specifically bind to other polypeptides. An antibody or a fragment thereof that immunospecifically binds to the polypeptide of the invention may cross-react with other antigens. Preferably, an antibody or a fragment thereof that immunospecifically binds to a polypeptide of the invention does not cross-react with other antigens. An antibody or a fragment thereof that immunospecifically binds to the polypeptide of the invention, can be identified by, for example, immunoassays or other techniques known to those skilled in the art.

An "isolated" or "purified" or "cloned" peptide or protein is substantially free of cellular material or other contaminating proteins from the cell or tissue source from which the protein is derived, or substantially free of chemical precursors or other chemicals when chemically synthesized. The language "substantially free of cellular material" includes preparations of a polypeptide/protein in which the polypeptide/protein is separated from cellular components of the cells from which it is isolated or recombinantly produced. Thus, a polypeptide/protein that is substantially free of cellular material includes preparations of the polypeptide/protein having less than about 30%, 20%, 10%, 5%, 2.5%, or 1%, (by dry weight) of contaminating protein. When the polypeptide/protein is recombinantly produced, it is also preferably substantially free of culture medium, i.e., culture medium represents less than about 20%, 10%, or 5% of the volume of the protein preparation. When polypeptide/protein is produced by chemical synthesis, it is preferably substantially free of chemical precursors or other chemicals, i.e., it is separated from chemical precursors or other chemicals which are involved in the synthesis of the protein. Accordingly, such preparations of the polypeptide/protein have less than about 30%, 20%, 10%, 5% (by dry weight) of chemical precursors or compounds other than polypeptide/protein fragment of interest. In a preferred embodiment of the present invention, polypeptides/proteins are isolated or purified.

An "isolated" nucleic acid molecule is one which is separated from other nucleic acid molecules which are present in the natural source of the nucleic acid molecule. Moreover, an "isolated" nucleic acid molecule, such as a cDNA molecule, can be substantially free of other cellular material, or culture medium when produced by recombinant techniques, or substantially free of chemical precursors or other chemicals when chemically synthesized. In a preferred embodiment of the invention, nucleic acid molecules encoding polypeptides/proteins of the invention are isolated or purified. The term "isolated" nucleic acid molecule does not include a nucleic acid that is a member of a library that has not been purified away from other library clones containing other nucleic acid molecules.

The term "portion" or "fragment" as used herein refers to a fragment of a nucleic acid molecule containing at least about 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 100, 150, 200, 250, 300, 350, 400, 450, 500, 550, 600, 650, 700, 750, 800, 850, 900, 950, 1000, 1050, 1100, 1150, 1200, 1250, 1300, 1350, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000, or more contiguous nucleic acids in length of the relevant nucleic acid molecule and having at least one functional feature of the nucleic acid molecule (or the encoded protein has one functional feature of the protein encoded by the nucleic acid molecule); or a fragment of a protein or a polypeptide containing at least 5, 10, 15, 20, 25, 30, 35, 40, 45, 50, 55, 60, 65, 70, 75, 80, 90, 100, 120, 140, 160, 180, 200, 220, 240, 260, 280, 300, 320, 340, 360, 400, 500, 600, 700, 800, 900, 1,000, 1,500, 2,000, 2,500, 3,000, 3,500, 4,000, 4,100, 4,200, 4,300, 4,350, 4,360, 4,370, 4,380 amino acid residues in length of the relevant protein or polypeptide and having at least one functional feature of the protein or polypeptide.

The term "having a biological activity of the protein" or "having biological activities of the polypeptides of the invention" refers to the characteristics of the polypeptides or proteins having a common biological activity similar or identical structural domain and/or having sufficient amino acid identity to the polypeptide encoded by the nucleic acid of the present invention. Such common biological activities of the polypeptides of the invention include antigenicity and immunogenicity.

The term "under stringent condition" refers to hybridization and washing conditions under which nucleotide sequences having at least 70%, at least 75%, at least 80%, at least 85%, at least 90%, or at least 95% identity to each other remain hybridized to each other. Such hybridization conditions are described in, for example but not limited to, Current Protocols in Molecular Biology, John Wiley & Sons, N.Y. (1989), 6.3.1-6.3.6.; Basic Methods in Molecular Biology, Elsevier Science Publishing Co., Inc., N.Y. (1986), pp. 75-78, and 84-87; and Molecular Cloning, Cold Spring Harbor Laboratory, N.Y. (1982), pp. 387-389, and are well known to those skilled in the art. A preferred, non-limiting example of stringent hybridization conditions is hybridization in 6× sodium chloride/sodium citrate (SSC), 0.5% SDS at about 68° C. followed by one or more washes (e.g., about 5 to 30 min each) in 2×SSC, 0.5% SDS at room temperature. Another preferred, non-limiting example of stringent hybridization conditions is hybridization in 6×SSC at about 45° C. followed by one or more washes (e.g., about 5 to 30 min each) in 0.2×SSC, 0.1% SDS at about 50-65° C.

The term "variant" as used herein refers either to a naturally occurring genetic mutant of SCoV-like virus or a recombinantly prepared variation of SCoV-like virus each of which contain one or more mutations in its genome compared to the hSARS virus. The term "variant" may also refers either to a naturally occurring variation of a given peptide or a recombinantly prepared variation of a given peptide or protein in which one or more amino acid residues have been modified by amino acid substitution, addition, or deletion.

4. BRIEF DESCRIPTION OF FIGURES

FIGS. 1A and B show the characteristics of animal SARS-CoV-like virus grown in FRhK-4 cells. (A) shows a negatively stained (potassium phosphotungstate, 2%) preparations of an animal virus isolate showing particles with club-shaped spikes surrounding the periphery of the particles. (B) shows a thin-section electron microscope view of the viral particles growing inside a cell (FRhK-4) and released through cell membrane.

FIG. 2 shows the additional 29 nucleotides (SEQ ID NO:1) found in animal SCoV-like virus.

FIG. 3 shows the entire genomic DNA sequence (SEQ ID NO:4) of the SARS virus deposited in GenBank with accession number AY278554.

FIG. 4 shows the deduced amino acid sequences (SEQ ID NOS:12-233, 235-729 and 731-1101) obtained from SEQ ID NO:4 in three frames. An asterisk (*) indicates a stop codon which marks the end of a peptide.

FIG. 5 shows the deduced amino acid sequences obtained from the complement (SEQ ID NO:1102) of SEQ ID NO:4 in three frames. An asterisk (*) indicates a stop codon which marks the end of a peptide.

FIG. 6 shows the genomic organization of human and animal SCoV-like viruses. (A) Genetic organization of SCoV-like viruses found in humans and animals. ORFs 1a and 1b, encoding the nonstructural polyproteins, and those encoding the S, E, M, and N structural proteins are indicated. (B) Expanded view of the SCoV genomic sequence (27700 nt to 28200 nt, based on AY278554 numbering). ORFs for putative proteins (9-11 and 13) and for N in human isolates are indicated (Peiris et al., 2003, *Lancet* 361:1319; Zhong et al., 2003, *Lancet* 362:1353). An extra 29 nucleotide sequence is present down-stream of the nucleotide of 27868 (based on AY278554 numbering) of the animal SCoV. The presence of this 29 nt sequence in animal isolates results in fusing the ORFs 10 (SEQ ID NO:8) and 11 (SEQ ID NO:9) (upper panel) into a new ORF (lower panel; ORF10'; SEQ ID NO:3). (C) Protein sequence alignment of ORF10 and 11 from human isolates and ORF 10' from animal isolates (SCoV-like virus strain SZ3, AY304486).

FIG. 7 shows the nucleotide sequence (SEQ ID NO:2) and its deduced amino acid sequence (SEQ ID NO:3) of a portion of the genome of SCoV-like virus (strain SZ3, AY304486) comprising SEQ ID NO:1, which is the additional 29 nucleotide residues not found in hSARS virus, resulting in encoding a new putative protein of 122 amino acids (SEQ ID NO:3).

Figure 8:
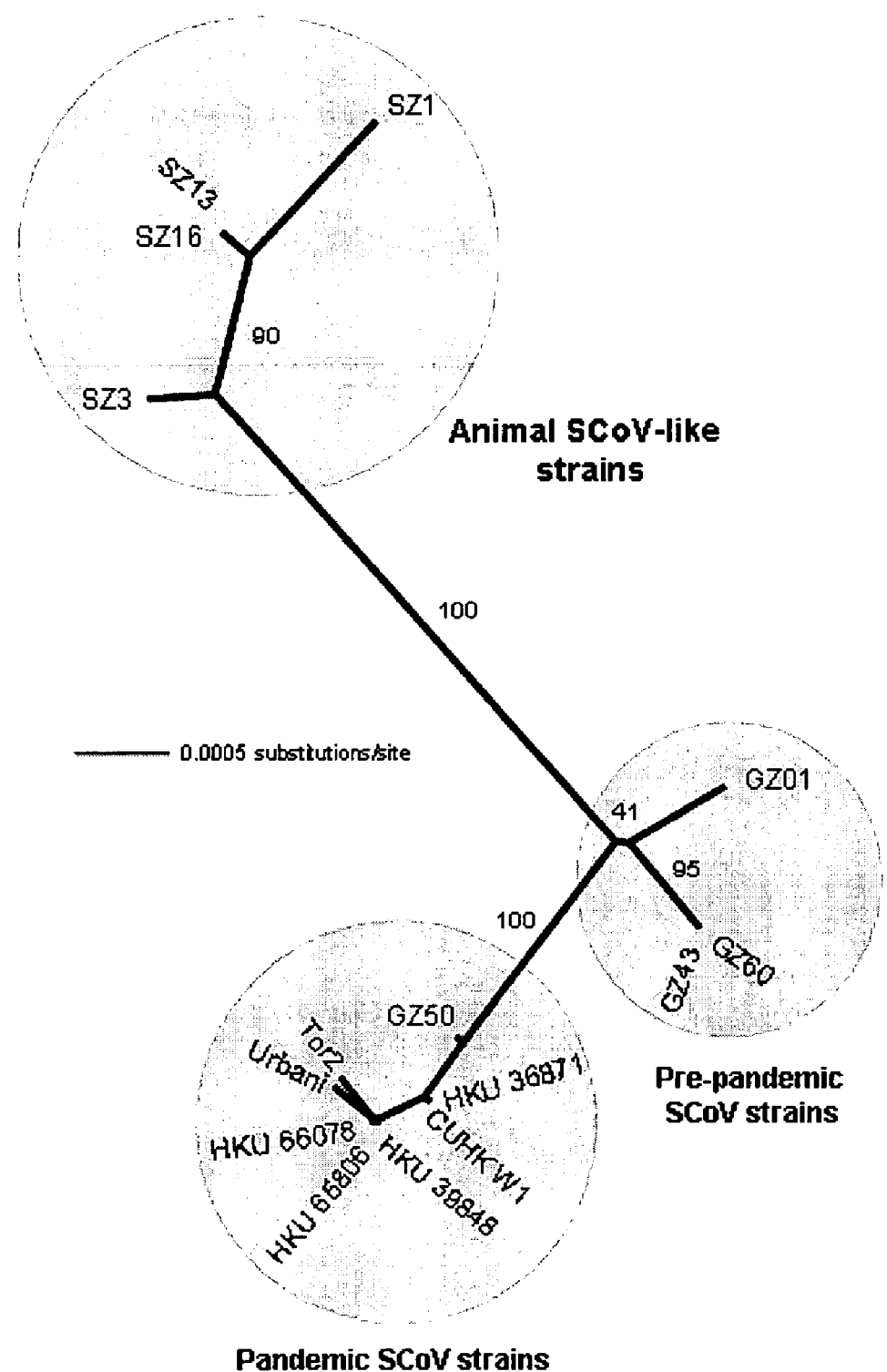

FIG. 8 shows a phylogenetic analysis of a partial nucleotide acid sequence of spike gene of SCoV-like viruses. An unrooted phylogram derived from the partial nucleotide sequence of representative SCoV S genes (S coding region residue 344 to 3765, 3422 bp). Multiple sequence alignments were done using Clustal X 1.81 and trees generated using Neighbor-Joining algorithms within PAUP 4.0b10. Bootstrap scores are percentages out of 1000 replicates. Similar tree topologies were seen with Maximum Parsimony analysis (data not shown). Except for the viruses sequenced in current study, the other sequences used in the analysis could be found in GenBank with accession number: AY278741, AY278554, AY278491, AY274119, and AY278489, all of which are incorporated by reference in their entirety.

5. DETAILED DESCRIPTION OF THE INVENTION

Severe acute respiratory syndrome (SARS) is a recently emerged human disease associated with pneumonia. This disease was first recognized in Guangdong Province, China in November 2002. Subsequent to its introduction to Hong Kong in mid February 2003, the virus spread to more than 28 countries causing disease in over 7,900 patients across 5 continents. The disease is unusual in its predilection to affect health care workers. A novel coronavirus (SCoV) was identified as the etiological agent of SARS (Peiris et al., 2003, *Lancet* 361:1319; Ksiazek et al., 2003, *N. Engl. J. Med.* 348:1953) and the virus causes a similar disease in cynomolgous macaques. Fouchier et al., 2003, *Nature* 423:240. While the majority of patients with SARS seroconvert to SCoV, patients with other respiratory disease and healthy blood donors had no detectable antibody. Peiris et al., 2003, *Lancet* 361:1319; Zhong et al., 2003, *Lancet* 362:1353). These results suggest that the human SCoV is an animal virus that crossed to humans relatively recently. Thus, identifying the animal reservoir is of major scientific interest as well as public health importance. A range of domestic and wild mammals in Guangdong Province were examined.

The present invention is based upon the inventor's isolation and identification of a class of novel viruses which is the precursor of the virus causing Severe Acute Respiratory Syndrome in humans ("hSARS virus"). The precursor virus which is a SARS coronavirus-like virus ("SCoV-like virus") is identified to be morphologically and phylogenetically similar to hSARS virus.

An investigation was carried out in a retail live animal market in Guangdong, mainland China, the hypothetical birthplace of SARS, to better understand the animal reservoir of this virus. SCoV-like coronaviruses were isolated from 4 of 6 Himalayan palm civets (*Paguma larvata*, Family Viverridae) and the serum from one of these animals neutralized the virus. Phylogenetic analysis indicates that these animal viruses have an ancestral relationship with the human SCoV with which they share genetic similarity. Sequence analysis revealed that all the animal virus isolates retain an "additional" 29 nucleotide residues which are not found in most human virus isolates which results in encoding a new putative protein of 122 amino acids. These 29 nucleotide residues are inserted at the nucleotide position corresponding to 27859 of GenBank accession no: AY278554 or 27874 of AY274119. The detection of SCoV-like viruses in small wild mammals found in live retail markets supplying the restaurant trade in Guangdong indicates how this virus may have crossed from its animal reservoir to humans. These findings are important for public health and may provide clues to understanding the inter-species transmission events relevant to the genesis of novel emerging diseases.

Accordingly, the present invention relates to a nucleotide sequence comprising the genomic sequence of the SCoV-like virus. The invention further relates to nucleotide sequences comprising a portion of the genomic sequence of the SCoV-like virus. The invention also relates to the deduced amino acid sequences of the SCoV-like virus. The invention further relates to the nucleic acids and peptides encoded by and/or derived from these sequences. In a specific embodiment, the invention provides the isolated SCoV-like virus that morphologically and phylogenetically relates to hSARS virus and comprises the nucleotide sequence of SEQ ID NO:1 in its genome. In another embodiment, the virus comprises a nucleotide sequence of SEQ ID NO:2. In another embodiment, the virus comprises a nucleotide sequence that encodes an amino acid sequence of SEQ ID NO:3. In a preferred embodiment, the virus comprises a nucleotide sequence of SEQ ID NO:1. In another specific embodiment, the virus preferably further comprises a nucleotide sequence of SEQ ID NO:2, portions thereof, or portions that hybridizes to the complement of SEQ ID NO:2, in its genome. In a specific embodiment, the present invention provides isolated nucleic acid molecules comprising or, alternatively, consisting of the nucleotide sequence of SEQ ID NO:1, a complement thereof or a portion thereof, preferably at least 3, 4, 5, 6, 7, 8, 9, 10, 11, 12, 13, 14, 15, 16, 17, 18, 19, 20, 21, 22, 23, 24, 25, 26, 27, or 28 nucleotides of the nucleic acid sequence of SEQ ID NO:1. In another specific embodiment, the present invention provides isolated nucleic acid molecules comprising or, alternatively, consisting of the nucleotide sequence of SEQ ID NO:2, a complement thereof or a portion thereof, preferably at least 5, 10, 15, 20, 25, 30, 35, 40, 45, 50, 60, 70, 80, 90, 100, 120, 140, 160, 180, 200, 220, 240, 260, 280, 300, 320, 340, 360, or more contiguous nucleotides of the nucleotide sequence of SEQ ID NO:2, or a complement thereof. In yet another specific embodiment, the present invention provides isolated nucleic acid molecules further comprising or, alternatively, consisting of the nucleotide sequence of SEQ ID NO:4, a complement thereof or a portion thereof, preferably at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000, or more contiguous nucleotides of the nucleotide sequence of SEQ ID NO:4, or a complement thereof. Furthermore, in another specific embodiment, the invention provides isolated nucleic acid molecules which hybridize under stringent conditions, as defined herein, to a nucleic acid molecule having the sequence of SEQ ID NO:1, 2, 4, or a complement, or a portion thereof. In one embodiment, the invention provides an isolated nucleic acid molecule which is antisense to the coding strand of a nucleic acid of the invention. In another specific embodiment, the invention provides isolated polypeptides or proteins that are encoded by a nucleic acid molecule comprising or, alternatively consisting of a nucleotide sequence that is at least 5, 10, 15, 20, 25, or 28 contiguous nucleotides of the nucleotide sequence of SEQ ID NO:1, or a complement thereof. In another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 50, 60, 70, 80, 90, 100, 120, 140, 160, 180, 200, 220, 240, 260, 280, 300, 320, 340, 360, or more contiguous nucleotides of the nucleotide sequence of SEQ ID NO:2, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:4, or a complement thereof.

The invention further provides proteins or polypeptides that are isolated from the SCoV-like virus, including viral proteins isolated from cells infected with the virus but not present in comparable uninfected cells. Specifically, the protein comprises the amino acid sequence of SEQ ID NO:3 or encoded by the nucleic acid of SEQ ID NO:2. The invention further provides proteins or polypeptides shown in FIG. 4 (SEQ ID NOS:12-233, 235-729 and 731-1101) and 5 (SEQ ID NOS:1103-1583, 1585-1958 and 1960-2464). The polypeptides or the proteins of the present invention preferably have a biological activity of the protein (including antigenicity and/or immunogenicity) encoded by the sequence of SEQ ID NO:1, 2, or a portion thereof, or their complements. In other embodiments, the polypeptides or the proteins of the present invention have a biological activity of the protein (including antigenicity and/or immunogenicity) encoded by a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:4, or a complement thereof.

In one aspect, the invention provides a method for propagating the SCoV-like virus in host cells comprising infecting the host cells with the isolated SCoV-like virus, culturing the host cells to allow the virus to multiply, and harvesting the resulting virions. Also provide by the present invention are host cells that are infected with the SCoV-like virus. In another aspect, the invention relates to the use of the isolated SCoV-like virus for diagnostic and therapeutic methods. In a specific embodiment, the invention provides a method of detecting in a biological sample an antibody immunospecific for the SCoV-like virus using the isolated SCoV-like virus or any proteins or polypeptides thereof. In another specific embodiment, the invention provides a method of screening for an antibody which immunospecifically binds and neutralizes SCoV-like virus. Such an antibody is useful for a passive immunization or immunotherapy of a subject infected with SCoV-like virus.

The invention further relates to the use of the sequence information of the isolated virus for diagnostic and therapeutic methods. In a specific embodiment, the invention provides nucleic acid molecules which are suitable for use as primers consisting of or comprising the nucleotide sequence of SEQ ID NO:1, 2, 4, or a complement thereof, or at least a portion of the nucleotide sequence thereof. In another specific embodiment, the invention provides nucleic acid molecules which are suitable for hybridization to SCoV-like nucleic acid, including, but not limited to, as PCR primers, Reverse Transcriptase primers, probes for Southern analysis or other nucleic acid hybridization analysis for the detection of SCo-V-like nucleic acids, e.g., consisting of or comprising the nucleotide sequence of SEQ ID NO:1, 2, 4, or a complement thereof, or a portion thereof. The invention further encompasses chimeric or recombinant viruses encoded in whole or in part by said nucleotide sequences.

The invention further provides antibodies that specifically bind a polypeptide of the invention encoded by the nucleotide sequence of SEQ ID NO:1, 2, or 4, or a fragment thereof, or encoded by a nucleic acid comprising a nucleotide sequence that hybridizes under stringent conditions to the nucleotide sequence of SEQ ID NO:1, 2, or 4, and/or any SCoV-like viral epitope, having one or more biological activities of a polypeptide of the invention. The invention further provides antibodies that specifically bind polypeptides of the invention encoded by the nucleotide sequence of SEQ ID NO:1, 2, or 4, or a fragment thereof. These polypeptides include those shown in FIGS. 4, 5 and 7. The invention further provides antibodies that specifically bind polypeptides of the invention encoded by a nucleic acid comprising a nucleotide sequence that hybridizes under stringent conditions to the nucleotide sequence of SEQ ID NO:1, 2, 4, and/or any SCo-V viral epitope, having one or more biological activities of a polypeptide of the invention. Such antibodies include, but are not limited to polyclonal, monoclonal, bi-specific, multi-specific, human, humanized, chimeric antibodies, single chain antibodies, Fab fragments, $F(ab')_2$ fragments, disulfide-linked Fvs, intrabodies and fragments containing either a VL or VH domain or even a complementary determining region (CDR) that specifically binds to a polypeptide of the invention.

In one embodiment, the invention provides methods for detecting the presence, activity or expression of the SCoV-like virus of the invention in a biological material, such as cells, blood, sputum, stool, saliva, urine, and so forth. The increased or decreased activity or expression of the SCoV-like virus in a sample relative to a control sample can be determined by contacting the biological material with an agent which can detect directly or indirectly the presence, activity or expression of the SCoV-like virus. In a specific embodiment, the detecting agents are the antibodies or nucleic acid molecules of the present invention.

In another embodiment, the invention provides vaccine preparations, comprising the SCoV-like virus, including recombinant and chimeric forms of said virus, or protein subunits of the virus. In a specific embodiment, the vaccine preparations of the present invention comprise live but attenuated SCoV-like virus with or without adjuvants. In another specific embodiment, the vaccine preparations of the invention comprise an inactivated or killed SCoV-like virus. Such attenuated or inactivated viruses may be prepared by a series of passages of the virus through the host cells or by preparing recombinant or chimeric forms of virus. Accordingly, the present invention further provides methods of preparing recombinant or chimeric forms of SCoV-like virus. In another specific invention, the vaccine preparations of the present invention comprise a nucleic acid or fragment of the SCoV-like virus, e.g., the virus having nucleic acid molecules having the sequence of SEQ ID NO. 1, 2, 4, or a fragment thereof. In another embodiment, the invention provides vaccine preparations comprising one or more polypeptides isolated from or produced from nucleic acid of SCoV-like virus. In a specific embodiment, the vaccine preparations comprise a polypeptide of the invention encoded by the nucleotide sequence of SEQ ID NO:1, 2, 4, or a fragment thereof. In a specific embodiment, the vaccine preparations comprise polypeptides of the invention as shown in FIG. 4, 5, or 7.

In another aspect, the present invention provides pharmaceutical compositions comprising anti-viral agents of the present invention and a pharmaceutically acceptable carrier. In a specific embodiment, the anti-viral agent of the invention is an antibody that immunospecifically binds SCoV-like virus or any SCoV-like viral epitope. In another specific embodiment, the anti-viral agent is a polypeptide or protein of the present invention or nucleic acid molecule of the invention. The invention also provides kits containing a pharmaceutical composition of the present invention.

Since the early cases of SARS in Guangdong reportedly occurred in restaurant workers handling wild mammals as exotic food (Zhong et al., 2003, *Lancet* 362:1353). A live animal retail market in Shenzhen was investigated. Animals were held, one per cage, in small wire cages. The animals sampled included seven wild, and one domestic animal species (Table 1). They originated from different regions of southern China and had been kept in separate storehouses before arrival to the market. The animals remain in the markets for a variable period of time and each stall holder has only a few animals of a given species. Animals from a different stalls within the market were sampled. Nasal and fecal swabs were collected and stored in viral transport medium. Where possible, blood samples were collected for serology. Prior to sampling, all animals were examined by a veterinary surgeon and confirmed to be free of overt disease.

Figures 1A, 1B:
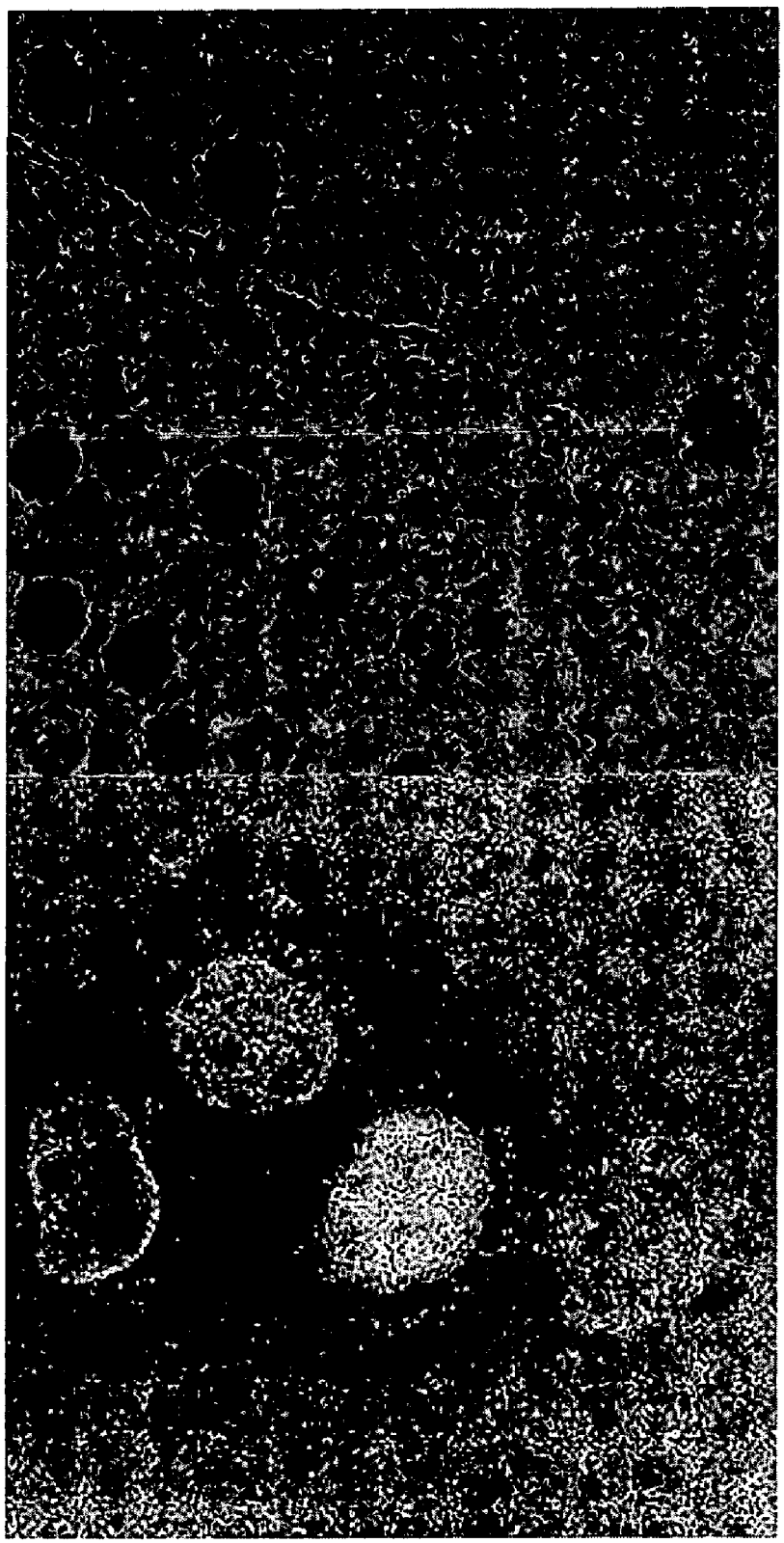

Nasal and fecal swabs were obtained from 25 animals and tested for SCoV viral nucleic acid using RT-PCR for the N gene of the hSARS. Swabs from 4 of 6 Himalayan palm civets were positive in the RT-PCR assay (Table 1). All specimens were inoculated on to FRhk-4 cells as previously described for virus isolation (Peiris et al., 2003, Lancet 361:1319). Cytopathic effect was observed in infected cells after 2-3 days post-infection specimens from 4 Himalayan palm civets (*Paguma larvata*), two of whom were also RT-PCR positive. Thus there was either RT-PCR or culture evidence of a virus in all 6 civets tested (Table 1). A virus was also detected by virus isolation and direct RT-PCR from the fecal swab of a Racoon-dog (*Nyctereutes procyonoides*). No virus was detectable in 6 other species sampled. Electron microscopy of one infected cell supernatant (SZ16N) showed viral particles with a morphology comparable to a coronavirus (FIG. 1) and all the virus isolates were confirmed to be SCoV-like viruses by RT-PCR and direct sequencing of the PCR product. Sera from three animals had neutralizing antibody to the animal coronavirus; these were from a palm civet, Racoon-dog and a Chinese ferret badger, respectively.

TABLE 1

Animal types tested and coronavirus detection

| Sample number | Animal type (Species) | Virus detection RT-PCR detection Nasal | Virus detection RT-PCR detection Fecal | Virus detection Isolation Nasal | Virus detection Isolation Fecal | Neutralizing antibody titer to SZ16 |
|---|---|---|---|---|---|---|
| SZ1 | HPC | + | + | | | <20 |
| SZ2 | HPC | + | + | | | <20 |
| SZ3 | HPC | + | + | + | | <20 |
| SZ4 | HB | | | | | <20 |
| SZ5 | B | | | | | <20 |
| SZ6 | DC | | | | | <20 |
| SZ7 | DC | | | | | <20 |
| SZ8 | CH | | | | | <20 |
| SZ9 | CH | | | | | <20 |
| SZ10 | CM | | | | | <20 |
| SZ11 | CFB | | | | | 160 |
| SZ12 | CFB | | | | | <20 |
| SZ13 | RD | | + | | + | ≧640 |
| SZ14 | CM | | | | | <20 |
| SZ15 | B | | | | | <20 |
| SZ16 | HPC | + | + | + | + | <20 |
| SZ17 | HPC | | + | | | ≧640 |
| SZ18 | B | | | | | <20 |
| SZ19 | CH | | | | | <20 |
| SZ20 | CH | | | | | <20 |
| SZ21 | DC | | | | | <20 |
| SZ22 | DC | | | | | <20 |
| SZ23 | HB | | | | | <20 |
| SZ24 | HB | | | | | <20 |
| SZ25 | HPC | | | | + | <20 |

Abbreviation of animal species: HPC, Himalayan palm civet (*Paguma larvata*); HB, Hog-badger (*Arctonyx collaris*); RD, Racoon-dog (*Nyctereutes procyonoides*); B, Beaver (Castor fiber); CM, Chinese muntjac (*Muntiacus reevesi*); DC, Domestic cat (*Felis catus*); CH, Chinese Hare (*Lepus sinensis*); CFB, Chinese Ferret-Badger (*Melogale moschata*) [China species information system provided at the web site of Wildlife Conservation Society (WCS) and Institute of Zoology].

+ positive by RT-PCR or virus isolation, * the PCR product or virus isolates being sequenced.

Two of the virus isolates (SZ3N and SZ16N) isolated from the nasal swabs of palm civets were completely sequenced and the amino acid sequence deduced. Two other viruses were partially sequenced, from the S gene onward to the 3' end of the virus. The full-length genome sequences had 99.8% homology to the human SCoV indicating the human and animal SCoV-like viruses were closely related. Phylogenetic analysis of the S gene of both human and animal SCoV-like viruses indicated that the animal viruses are separate from the human virus cluster (FIG. 8). However, the viruses SZ1, SZ3 and SZ16 from palm civets were not clonally related (FIG. 8). The viruses SZ3 and SZ16 had 18 nucleotide differences between them over the 29,709 base pair genome while the human SCoV cluster of 5 geographically separated human viruses (GZ50, CUHK-W1, Tor-2, HKU-39848 and Urbani, FIG. 7) differed by only 14 nucleotides. On the other hand, animal viruses SZ13 (Racoon-dog) and SZ16 (palm civet) were genetically almost identical.

When viruses in the human and animal groups are compared, 72 to 86 nucleotide differences were observed over the whole virus genome, many of them scattered across the whole genome. However, there were 19 consistent nucleotide differences between animal and human viruses localized in the S (Table 2) and M genes, 15 of them being non-synonymous mutations. Interestingly, some of the human virus isolates (e.g. GZ43 and GZ60) share some of the amino acid residues (positions 22192, 23470 and 23808, based on AY278554 numbering) with animal viruses (Table 2) suggesting that the human viruses isolated during the early phase of the SARS outbreak retained some of the "signatures" of the animal precursor.

TABLE 2

Nucleotide and amino acid substitutions of the SCoV-like viruses and SCoV

| Gene | S | | | | | | | |
|---|---|---|---|---|---|---|---|---|
| Site* | 22157 | 22192 | 22258 | 22555 | 22913 | 23148 | 23295 | 23470 |
| SZ3 | A (K) | T (L) | A (K) | C (S) | A (K) | T (F) | C (P) | C (S) |
| SZ16 | A (K) | T (L) | A (K) | C (S) | A (K) | A (I) | C (P) | C (S) |
| SZ1 | A (K) | T (L) | A (K) | C (S) | A (K) | A (I) | C (P) | C (S) |
| SZ13 | A (K) | T (L) | A (K) | C (S) | A (K) | A (I) | C (P) | C (S) |
| GZ43 | C (N) | T (L) | C (T) | T (F) | T (N) | T (F) | T (S) | C (S) |
| GZ60 | C (N) | T (L) | C (T) | T (F) | T (N) | T (F) | T (S) | C (S) |
| GZ50 | C (N) | C (S) | C (T) | T (F) | T (N) | T (F) | T (S) | T (L) |
| CUHK-W1 | C (N) | C (S) | C (T) | T (F) | T (N) | T (F) | T (S) | T (L) |
| HKU-36871 | C (N) | C (S) | C (T) | T (F) | T (N) | T (F) | T (S) | T (L) |
| HKU-39848 | C (N) | C (S) | C (T) | T (F) | T (N) | T (F) | T (S) | T (L) |
| HKU-66078 | C (N) | C (S) | C (T) | T (F) | T (N) | T (F) | T (S) | T (L) |
| HKU-65806 | C (N) | C (S) | C (T) | T (F) | T (N) | T (F) | T (S) | T (L) |
| Urbani | C (N) | C (S) | C (T) | T (F) | T (N) | T (F) | T (S) | T (L) |
| Tor2 | C (N) | C (S) | C (T) | T (F) | T (N) | T (F) | T (S) | T (L) |

TABLE 2-continued

Nucleotide and amino acid substitutions of the SCoV-like viruses and SCoV

| Gene | S | | | | | | M |
|---|---|---|---|---|---|---|---|
| Site* | 23578 | 23703 | 23737 | 23808 | 24156 | 24963 | 26395 |
| SZ3 | T (L) | G (A) | T (V) | G (D) | G (A) | G (E) | A (S) |
| SZ16 | T (L) | G (A) | T (V) | G (D) | G (A) | G (E) | A (S) |
| SZ1 | T (L) | G (A) | T (V) | G (D) | G (A) | G (E) | A (S) |
| SZ13 | T (L) | G (A) | T (V) | G (D) | G (A) | G (E) | A (S) |
| GZ43 | C (S) | A (T) | C (A) | G (D) | A (T) | A (K) | G (G) |
| GZ60 | C (S) | A (T) | C (A) | G (D) | A (T) | A (K) | G (G) |
| GZ50 | C (S) | A (T) | C (A) | G (D) | A (T) | A (K) | G (G) |
| CUHK-W1 | C (S) | A (T) | C (A) | T (Y) | A (T) | A (K) | G (G) |
| HKU-36871 | C (S) | A (T) | C (A) | T (Y) | A (T) | A (K) | G (G) |
| HKU-39848 | C (S) | A (T) | C (A) | T (Y) | A (T) | A (K) | G (G) |
| HKU-66078 | C (S) | A (T) | C (A) | T (Y) | A (T) | A (K) | G (G) |
| HKU-65806 | C (S) | A (T) | C (A) | T (Y) | A (T) | A (K) | G (G) |
| Urbani | C (S) | A (T) | C (A) | T (Y) | A (T) | A (K) | G (G) |
| Tor2 | C (S) | A (T) | C (A) | T (Y) | A (T) | A (K) | G (G) |

Numbering based on AY278554.

The most striking genetic difference between the animal and human virus groups was that the human viruses (with the exception of GZ01) all share a 29 nucleotide acid (nt) deletion [5'-CCTACTGGTTACCAACCTGAATGGAATAT-3' (SEQ ID NO:1), residue 27869 to 27897] at 246 nucleotide upstream of the start codon of the N gene. Sequence analysis of the animal isolates revealed that all of them retain this "additional" 29 nucleotide sequence. This 29 base pair deletion might have occurred during adaptation to humans and for to human to human transmission. Interestingly, the existence of this additional sequence in the animal viruses results in demolishing the open reading frames (ORFs) 10 and 11 (Marra et al., Science May 1 2003:1085953, electronically published at the web site of American Association for the Advancement of Science) and merging these two ORFs into a new ORF encoding a putative protein of 122 amino acid. This 122 amino acids putative peptide has a high homology to the putative proteins encoded by ORF10 and ORF12. Since the ORF11 does not have a typical transcription regulatory sequence for SCoV the putative ORF11 may be the direct result of the deletion of the 29 nt sequence. The loss of this peptide may help the virus in its adaptation to transmit efficiently from human to human.

Phylogenetic analysis of the S gene of both human and animal viruses indicated that the animal viruses are separated from the human virus cluster (FIG. 8). Taken together with the fact that most human SCoV have a deletion in the non-coding region of the genome, it is highly unlikely that the isolation of SCoV-like viruses in these wild animals is due to the reverse transmission of SCoV from human to animal. A more plausible hypothesis for these observations is that these animal viruses are the precursor of the human SCoV or that both the human and these animal viruses have been infected from the same source.

Of the eight animal species investigated in the market, two species, viz. palm civet and Racoon-dog had virus isolated from them and a third, (Chinese ferret badger) had serological evidence of infection. It is clear that a number of these species can amplify the virus within the retail market setting and are probably important from the point of view of public health. These animals may be the natural reservoir infection in the wild or that both humans and civets, Racoon-dog and ferret badgers were all infected from another animal source, which is in fact the true reservoir in nature. Alternatively, these market animals may be an intermediate host that, because of the culinary practices of southern China, brings the virus into close proximity with humans. However, the virus infected civets and Racoon-dogs were apparently healthy suggesting that virus is well adapted to this species and may be in ecological equilibrium with each other. This shows that the civet (or Racoon-dog) being a natural reservoir rather than a short-term incidental host.

5.1 Recombinant and Chimeric SCoV-Like Viruses

The present invention encompasses recombinant or chimeric viruses encoded by viral vectors derived from the genome of SCoV-like virus or natural variants thereof. In another specific embodiment, a recombinant virus is one derived from a natural variant of SCoV-like virus. A natural variant of SCoV-like virus has a sequence that is different from the genomic sequence (SEQ ID NO:4) of the hSARS virus, due to one or more naturally occurred mutations, including, but not limited to, point mutations, rearrangements, insertions, deletions etc., to the genomic sequence that may or may not result in a phenotypic change. In accordance with the present invention, a viral vector which is derived from the genome of the SCoV-like virus, is one that contains a nucleic acid sequence that encodes at least a part of one ORF of the virus. In a specific embodiment, the ORF comprises or consists of a nucleotide sequence of SEQ ID NO:1, 2, or 4, or a fragment thereof. In a specific embodiment, there are more than one ORF within the nucleotide sequence of SCoV-like virus, as shown in FIG. 4, 5 or 7, or a fragment thereof. In another embodiment, the polypeptide encoded by the ORF comprises or consists of an amino acid sequence of SEQ ID NO:3, or a fragment thereof, or shown in FIG. 4, 5, or 7, or a fragment thereof. In accordance with the present invention these viral vectors may or may not include nucleic acids that are non-native to the viral genome.

In another specific embodiment, a chimeric virus of the invention is a recombinant SCoV-like virus which further comprises a heterologous nucleotide sequence. In accordance with the invention, a chimeric virus may be encoded by a nucleotide sequence in which heterologous nucleotide sequences have been added to the genome or in which endogenous or native nucleotide sequences have been replaced with heterologous nucleotide sequences.

According to the present invention, the chimeric viruses are encoded by the viral vectors of the invention which further comprise a heterologous nucleotide sequence. In accordance with the present invention a chimeric virus is encoded by a viral vector that may or may not include nucleic acids that are non-native to the viral genome. In accordance with the invention a chimeric virus is encoded by a viral vector to which heterologous nucleotide sequences have been added, inserted or substituted for native or non-native sequences. In accordance with the present invention, the chimeric virus may be encoded by nucleotide sequences derived from different strains or variants of SCoV-like virus. In particular, the chimeric virus is encoded by nucleotide sequences that encode antigenic polypeptides derived from different strains or variants of SCoV-like virus.

A chimeric virus may be of particular use for the generation of recombinant vaccines protecting against two or more viruses (Tao et al., J. Virol. 72, 2955-2961; Durbin et al., 2000, J. Virol. 74, 6821-6831; Skiadopoulos et al., 1998, J. Virol. 72, 1762-1768 (1998); Teng et al., 2000, J. Virol. 74, 9317-9321). For example, it can be envisaged that a virus vector derived from the SCoV-like virus expressing one or more proteins of variants of SCoV-like virus, or vice versa, will protect a subject vaccinated with such vector against infections by both the native SCoV-like virus and the variant. Attenuated and replication-defective viruses may be of use for vaccination purposes with live vaccines as has been suggested for other viruses. (See, PCT WO 02/057302, at pp. 6 and 23, incorporated by reference herein).

In accordance with the present invention the heterologous sequence to be incorporated into the viral vectors encoding the recombinant or chimeric viruses of the invention include sequences obtained or derived from different strains or variants of SCoV-like virus.

In certain embodiments, the chimeric or recombinant viruses of the invention are encoded by viral vectors derived from viral genomes wherein one or more sequences, intergenic regions, termini sequences, or portions or entire ORF have been substituted with a heterologous or non-native sequence. In certain embodiments of the invention, the chimeric viruses of the invention are encoded by viral vectors derived from viral genomes wherein one or more heterologous sequences have been inserted or added to the vector.

The selection of the viral vector may depend on the species of the subject that is to be treated or protected from a viral infection. If the subject is human, then an attenuated SCoV-like virus can be used to provide the antigenic sequences.

In accordance with the present invention, the viral vectors can be engineered to provide antigenic sequences which confer protection against infection by the SCoV-like virus and natural variants thereof. The viral vectors may be engineered to provide one, two, three or more antigenic sequences. In accordance with the present invention the antigenic sequences may be derived from the same virus, from different strains or variants of the same type of virus, or from different viruses.

The expression products and/or recombinant or chimeric virions obtained in accordance with the invention may advantageously be utilized in vaccine formulations. The expression products and chimeric virions of the present invention may be engineered to create vaccines against a broad range of pathogens, including viral and bacterial antigens, tumor antigens, allergen antigens, and auto antigens involved in autoimmune disorders. In particular, the chimeric virions of the present invention may be engineered to create vaccines for the protection of a subject from infections with SCoV-like virus and variants thereof.

In certain embodiments, the expression products and recombinant or chimeric virions of the present invention may be engineered to create vaccines against a broad range of pathogens, including viral antigens, tumor antigens and autoantigens involved in autoimmune disorders. One way to achieve this goal involves modifying existing SCoV-like viral genes to contain foreign sequences in their respective external domains. Where the heterologous sequences are epitopes or antigens of pathogens, these chimeric viruses may be used to induce a protective immune response against the disease agent from which these determinants are derived.

Thus, the present invention relates to the use of viral vectors and recombinant or chimeric viruses to formulate vaccines against a broad range of viruses and/or antigens. The present invention also encompasses recombinant viruses comprising a viral vector derived from the SCoV-like virus or variants thereof which contains sequences which result in a virus having a phenotype more suitable for use in vaccine formulations, e.g., attenuated phenotype or enhanced antigenicity. The mutations and modifications can be in coding regions, in intergenic regions and in the leader and trailer sequences of the virus.

The invention provides a host cell comprising a nucleic acid or a vector according to the invention. Plasmid or viral vectors containing the polymerase components of SCoV-like virus are generated in prokaryotic cells for the expression of the components in relevant cell types (bacteria, insect cells, eukaryotic cells). Plasmid or viral vectors containing full-length or partial copies of the SCoV-like viral genome will be generated in prokaryotic cells for the expression of viral nucleic acids in-vitro or in-vivo. The latter vectors may contain other viral sequences for the generation of chimeric viruses or chimeric virus proteins, may lack parts of the viral genome for the generation of replication defective virus, and may contain mutations, deletions or insertions for the generation of attenuated viruses. In addition, the present invention provides a host cell infected with SCoV-like virus.

Infectious copies of SCoV-like virus (being wild type, attenuated, replication-defective or chimeric) can be produced upon co-expression of the polymerase components according to the state-of-the-art technologies described above.

In addition, eukaryotic cells, transiently or stably expressing one or more full-length or partial proteins can be used. Such cells can be made by transfection (proteins or nucleic acid vectors), infection (viral vectors) or transduction (viral vectors) and may be useful for complementation of mentioned wild type, attenuated, replication-defective or chimeric viruses.

The viral vectors and chimeric viruses of the present invention may be used to modulate a subject's immune system by stimulating a humoral immune response, a cellular immune response or by stimulating tolerance to an antigen. As used herein, a subject means: humans, primates, horses, cows, sheep, pigs, goats, dogs, cats, avian species, rodents, raccoon-dog, civet, and ferret.

5.2 Formulation of Vaccines and Antivirals

In a preferred embodiment, the invention provides a proteinaceous molecule or SCoV-like virus specific viral protein or functional fragment thereof encoded by a nucleic acid according to the invention. Useful proteinaceous molecules are for example derived from any of the genes or genomic fragments derivable from the virus according to the invention, including envelop protein (E protein), integral membrane protein (M protein), spike protein (S protein), nucleocapsid protein (N protein), hemaglutinin esterase (HE protein), and RNA-dependent RNA polymerase. Such molecules, or antigenic fragments thereof, as provided herein, are for example useful in diagnostic methods or kits and in pharmaceutical compositions such as subunit vaccines. Particularly useful are polypeptides encoded by the nucleotide sequence of SEQ ID NO:1, 2, or 4, or as shown in FIGS. 4, 5, 7, or antigenic fragments thereof for inclusion as antigen or subunit immunogen, but inactivated whole virus can also be used. Particularly useful are also those proteinaceous substances that are encoded by recombinant nucleic acid fragments of the SCoV-like viral genome, of course preferred are those that are within the preferred bounds and metes of ORFs, in particular, for eliciting SCoV-like virus specific antibody or T cell responses, whether in vivo (e.g. for protective or therapeutic purposes or for providing diagnostic antibodies) or in vitro (e.g. by phage display technology or another technique useful for generating synthetic antibodies).

The invention provides vaccine formulations for the prevention and treatment of infections with SCoV-like virus. In certain embodiments, the vaccine of the invention comprises recombinant and chimeric viruses of the SCoV-like virus. In certain embodiments, the virus is attenuated.

In another embodiment of this aspect of the invention, inactivated vaccine formulations may be prepared using conventional techniques to "kill" the chimeric viruses. Inactivated vaccines are "dead" in the sense that their infectivity has been destroyed. Ideally, the infectivity of the virus is destroyed without affecting its immunogenicity. In order to prepare inactivated vaccines, the chimeric virus may be grown in cell culture or in the allantois of the chick embryo, purified by zonal ultracentrifugation, inactivated by formaldehyde or β-propiolactone, and pooled. The resulting vaccine is usually inoculated intramuscularly.

Inactivated viruses may be formulated with a suitable adjuvant in order to enhance the immunological response. Such adjuvants may include but are not limited to mineral gels, e.g., aluminum hydroxide; surface active substances such as lysolecithin, pluronic polyols, polyanions; peptides; oil emulsions; and potentially useful human adjuvants such as BCG and *Corynebacterium parvum*.

In another aspect, the present invention also provides DNA vaccine formulations comprising a nucleic acid or fragment of the SCoV-like virus, or nucleic acid molecules having the sequence of SEQ ID NO:1, 2, or 4, or a fragment thereof. In another specific embodiment, the DNA vaccine formulations of the present invention comprises a nucleic acid or fragment thereof encoding the antibodies which immunospecifically binds SCoV-like viruses. In DNA vaccine formulations, a vaccine DNA comprises a viral vector, such as that derived from the SCoV-like virus, bacterial plasmid, or other expression vector, bearing an insert comprising a nucleic acid molecule of the present invention operably linked to one or more control elements, thereby allowing expression of the vaccinating proteins encoded by said nucleic acid molecule in a vaccinated subject. Such vectors can be prepared by recombinant DNA technology as recombinant or chimeric viral vectors carrying a nucleic acid molecule of the present invention (see also Section 5.1, supra).

Various heterologous vectors are described for DNA vaccinations against viral infections. For example, the vectors described in the following references may be used to express SCoV-like viral sequences instead of the sequences of the viruses or other pathogens described; in particular, vectors described for hepatitis B virus (Michel, M. L. et al., 1995, DNA-mediated immunization to the hepatitis B surface antigen in mice: Aspects of the humoral response mimic hepatitis B viral infection in humans, *Proc. Natl. Aca. Sci. USA* 92:5307-5311; Davis, H. L. et al., 1993, DNA-based immunization induces continuous seretion of hepatitis B surface antigen and high levels of circulating antibody, *Human Molec. Genetics* 2:1847-1851), HIV virus (Wang, B. et al., 1993, Gene inoculation generates immune responses against human immunodeficiency virus type 1, *Proc. Natl. Acad. Sci. USA* 90:4156-4160; Lu, S. et al., 1996, Simian immunodeficiency virus DNA vaccine trial in macques, *J. Virol.* 70:3978-3991; Letvin, N. L. et al., 1997, Potent, protective anti-HIV immune responses generated by bimodal HIV envelope DNA plus protein vaccination, *Proc Natl Acad Sci USA*. 94(17):9378-83), and influenza viruses (Robinson, H L et al., 1993, Protection against a lethal influenza virus challenge by immunization with a haemagglutinin-expressing plasmid DNA, *Vaccine* 11:957-960; Ulmer, J. B. et al., Heterologous protection against influenza by injection of DNA encoding a viral protein, *Science* 259:1745-1749), as well as bacterial infections, such as tuberculosis (Tascon, R. E. et al., 1996, Vaccination against tuberculosis by DNA injection, *Nature Med.* 2:888-892; Huygen, K. et al., 1996, Immunogenicity and protective efficacy of a tuberculosis DNA vaccine, *Nature Med.,* 2:893-898), and parasitic infection, such as malaria (Sedegah, M., 1994, Protection against malaria by immunization with plasmid DNA encoding circumsporozoite protein, *Proc. Natl. Acad. Sci. USA* 91:9866-9870; Doolan, D. L. et al., 1996, Circumventing genetic restriction of protection against malaria with multigene DNA immunization: CD8+ T cell-interferon δ, and nitric oxide-dependent immunity, *J. Exper. Med.,* 1183:1739-1746).

Many methods may be used to introduce the vaccine formulations described above. These include, but are not limited to, oral, intradermal, intramuscular, intraperitoneal, intravenous, subcutaneous, and intranasal routes. Alternatively, it may be preferable to introduce the chimeric virus vaccine formulation via the natural route of infection of the pathogen for which the vaccine is designed. The DNA vaccines of the present invention may be administered in saline solutions by injections into muscle or skin using a syringe and needle (Wolff J. A. et al., 1990, Direct gene transfer into mouse muscle in vivo, *Science* 247:1465-1468; Raz, E., 1994, Intradermal gene immunization: The possible role of DNA uptake in the induction of cellular immunity to viruses, *Proc. Natl. Acd. Sci. USA* 91:9519-9523). Another way to administer DNA vaccines is called "gene gun" method, whereby microscopic gold beads coated with the DNA molecules of interest is fired into the cells (Tang, D. et al., 1992, Genetic immunization is a simple method for eliciting an immune response, *Nature* 356:152-154). For general reviews of the methods for DNA vaccines, see Robinson, H. L., 1999, DNA vaccines: basic mechanism and immune responses (Review), *Int. J. Mol. Med.* 4(5):549-555; Barber, B., 1997, Introduction: Emerging vaccine strategies, *Seminars in Immunology* 9(5):269-270; and Robinson, H. L. et al., 1997, DNA vaccines, *Seminars in Immunology* 9(5):271-283.

5.3 Attenuation of SCoV-Like Virus or Variants Thereof

The SCoV-like virus or variants thereof of the invention can be genetically engineered to exhibit an attenuated phenotype. In particular, the viruses of the invention exhibit an attenuated phenotype in a subject to which the virus is administered as a vaccine. Attenuation can be achieved by any method known to a skilled artisan. Without being bound by theory, the attenuated phenotype of the viruses of the invention can be caused, e.g., by using a virus that naturally does not replicate well in an intended host species, for example, by reduced replication of the viral genome, by reduced ability of the virus to infect a host cell, or by reduced ability of the viral proteins to assemble to an infectious viral particle relative to the wild type strain of the virus.

The attenuated phenotypes of SCoV-like virus or variants thereof can be tested by any method known to the artisan. A candidate virus can, for example, be tested for its ability to infect a host or for the rate of replication in a cell culture system. In certain embodiments, growth curves at different temperatures are used to test the attenuated phenotype of the virus. For example, an attenuated virus is able to grow at 35° C., but not at 39° C. or 40° C. In certain embodiments, different cell lines can be used to evaluate the attenuated phenotype of the virus. For example, an attenuated virus may only be able to grow in monkey cell lines but not the human cell lines, or the achievable virus titers in different cell lines are different for the attenuated virus. In certain embodiments, viral replication in the respiratory tract of a small animal model, including but not limited to, hamsters, cotton rats, mice and guinea pigs, is used to evaluate the attenuated phenotypes of the virus. In other embodiments, the immune response induced by the virus, including but not limited to, the antibody titers (e.g., assayed by plaque reduction neutralization assay or ELISA) is used to evaluate the attenuated phenotypes of the virus. In a specific embodiment, the plaque reduction neutralization assay or ELISA is carried out at a low dose. In certain embodiments, the ability of the SCoV-like virus to elicit pathological symptoms in an animal model can be tested. A reduced ability of the virus to elicit pathological symptoms in an animal model system is indicative of its attenuated phenotype. In a specific embodiment, the candidate viruses are tested in a monkey model for nasal infection, indicated by mucous production.

The viruses of the invention can be attenuated such that one or more of the functional characteristics of the virus are impaired. In certain embodiments, attenuation is measured in comparison to the wild type strain of the virus from which the attenuated virus is derived. In other embodiments, attenuation is determined by comparing the growth of an attenuated virus in different host systems. Thus, for a non-limiting example, SCoV-like virus or a variant thereof is said to be attenuated when grown in a human host if the growth of the SCoV-like virus or variant thereof in the human host is reduced compared to the non-attenuated SCoV-like virus or variant thereof.

In certain embodiments, the attenuated virus of the invention is capable of infecting a host, is capable of replicating in a host such that infectious viral particles are produced. In comparison to the wild type strain, however, the attenuated strain grows to lower titers or grows more slowly. Any technique known to the skilled artisan can be used to determine the growth curve of the attenuated virus and compare it to the growth curve of the wild type virus.

In certain embodiments, the attenuated virus of the invention (e.g., a recombinant or chimeric SCoV-like virus) cannot replicate in human cells as well as the wild type virus (e.g., wild type SCoV-like virus) does. However, the attenuated virus can replicate well in a cell line that lack interferon functions, such as Vero cells.

In other embodiments, the attenuated virus of the invention is capable of infecting a host, of replicating in the host, and of causing proteins of the virus of the invention to be inserted into the cytoplasmic membrane, but the attenuated virus does not cause the host to produce new infectious viral particles. In certain embodiments, the attenuated virus infects the host, replicates in the host, and causes viral proteins to be inserted in the cytoplasmic membrane of the host with the same efficiency as the wild type SCoV-like virus. In other embodiments, the ability of the attenuated virus to cause viral proteins to be inserted into the cytoplasmic membrane into the host cell is reduced compared to the wild type virus. In certain embodiments, the ability of the attenuated SCoV-like virus to replicate in the host is reduced compared to the wild type virus. Any technique known to the skilled artisan can be used to determine whether a virus is capable of infecting a mammalian cell, of replicating within the host, and of causing viral proteins to be inserted into the cytoplasmic membrane of the host.

In certain embodiments, the attenuated virus of the invention is capable of infecting a host. In contrast to the wild type SCoV-like virus, however, the attenuated SCoV-like virus cannot be replicated in the host. In a specific embodiment, the attenuated SCoV-like virus can infect a host and can cause the host to insert viral proteins in its cytoplasmic membranes, but the attenuated virus is incapable of being replicated in the host. Any method known to the skilled artisan can be used to test whether the attenuated SCoV-like virus has infected the host and has caused the host to insert viral proteins in its cytoplasmic membranes.

In certain embodiments, the ability of the attenuated virus to infect a host is reduced compared to the ability of the wild type virus to infect the same host. Any technique known to the skilled artisan can be used to determine whether a virus is capable of infecting a host.

In certain embodiments, mutations (e.g., missense mutations) are introduced into the genome of the virus, for example, into the sequence of SEQ ID NO:1, 2, 4, or to generate a virus with an attenuated phenotype. Mutations (e.g., missense mutations) can be introduced into the structural genes and/or regulatory genes of the SCoV-like virus. Mutations can be additions, substitutions, deletions, or combinations thereof. Such variant of SCoV-like virus can be screened for a predicted functionality, such as infectivity, replication ability, protein synthesis ability, assembling ability, as well as cytopathic effect in cell cultures. In a specific embodiment, the missense mutation is a cold-sensitive mutation. In another embodiment, the missense mutation is a heat-sensitive mutation. In another embodiment, the missense mutation prevents a normal processing or cleavage of the viral proteins.

In other embodiments, deletions are introduced into the genome of the SCoV-like virus, which result in the attenuation of the virus.

In certain embodiments, attenuation of the virus is achieved by replacing a gene of the wild type virus with a gene of a virus of a different species, of a different subgroup, or of a different variant. In another aspect, attenuation of the virus is achieved by replacing one or more specific domains of a protein of the wild type virus with domains derived from the corresponding protein of a virus of a different species. In certain other embodiments, attenuation of the virus is achieved by deleting one or more specific domains of a protein of the wild type virus.

When a live attenuated vaccine is used, its safety must also be considered. The vaccine must not cause disease. Any techniques known in the art that can make a vaccine safe may be used in the present invention. In addition to attenuation techniques, other techniques may be used. One non-limiting example is to use a soluble heterologous gene that cannot be incorporated into the virion membrane. For example, a single copy of the soluble version of a viral transmembrane protein lacking the transmembrane and cytosolic domains thereof, can be used.

Various assays can be used to test the safety of a vaccine. For example, sucrose gradients and neutralization assays can be used to test the safety. A sucrose gradient assay can be used to determine whether a heterologous protein is inserted in a virion. If the heterologous protein is inserted in the virion, the virion should be tested for its ability to cause symptoms in an appropriate animal model since the virus may have acquired new, possibly pathological, properties.

5.4 Adjuvants and Carrier Molecules

SCoV-like-viral-associated antigens are administered with one or more adjuvants.

In one embodiment, the SCoV-like-viral-associated antigen is administered together with a mineral salt adjuvants or mineral salt gel adjuvant. Such mineral salt and mineral salt gel adjuvants include, but are not limited to, aluminum hydroxide (ALHYDROGEL, REHYDRAGEL), aluminum phosphate gel, aluminum hydroxyphosphate (ADJU-PHOS), and calcium phosphate.

In another embodiment, SCoV-like-viral-associated antigen is administered with an immunostimulatory adjuvant. Such class of adjuvants, include, but are not limited to, cytokines (e.g., interleukin-2, interleukin-7, interleukin-12, granulocyte-macrophage colony stimulating factor (GM-CSF), interfereon-γ interleukin-1β (IL-1β), and IL-1β peptide or Sclavo Peptide), cytokine-containing liposomes, triterpenoid glycosides or saponins (e.g., QuilA and QS-21, also sold under the trademark STIMULON, ISCOPREP), Muramyl Dipeptide (MDP) derivatives, such as N-acetyl-muramyl-L-threonyl-D-isoglutamine (Threonyl-MDP, sold under the trademark TERMURTIDE), GMDP, N-acetyl-nor-muramyl-L-alanyl-D-isoglutamine, N-acetylmuramyl-L-alanyl-D-isoglutaminyl-L-alanine-2-(1'-2'-dipalmitoyl-sn-glycero-3-hydroxy phosphoryloxy)-ethylamine, muramyl tripeptide phosphatidylethanolamine (MTP-PE), unmethylated CpG dinucleotides and oligonucleotides, such as bacterial DNA and fragments thereof, LPS, monophosphoryl Lipid A (3D-MLA sold under the trademark MPL), and polyphosphazenes.

In another embodiment, the adjuvant used is a particular adjuvant, including, but not limited to, emulsions, e.g., Freund's Complete Adjuvant, Freund's Incomplete Adjuvant, squalene or squalane oil-in-water adjuvant formulations, such as SAF and MF59, e.g., prepared with block-copolymers, such as L-121 (polyoxypropylene/polyoxyetheylene) sold under the trademark PLURONIC L-121, Liposomes, Virosomes, cochleates, and immune stimulating complex, which is sold under the trademark ISCOM.

In another embodiment, a microparticular adjuvant is used. Microparticular adjuvants include, but are not limited to biodegradable and biocompatible polyesters, homo- and copolymers of lactic acid (PLA) and glycolic acid (PGA), poly(lactide-co-glycolides) (PLGA) microparticles, polymers that self-associate into particulates (poloxamer particles), soluble polymers (polyphosphazenes), and virus-like particles (VLPs) such as recombinant protein particulates, e.g., hepatitis B surface antigen (HbsAg).

Yet another class of adjuvants that may be used include mucosal adjuvants, including, but not limited to heat-labile enterotoxin from *Escherichia coli* (LT), cholera holotoxin (CT) and cholera Toxin B Subunit (CTB) from *Vibrio cholerae*, mutant toxins (e.g., LTK63 and LTR72), microparticles, and polymerized liposomes.

In other embodiments, any of the above classes of adjuvants may be used in combination with each other or with other adjuvants. For example, non-limiting examples of combination adjuvant preparations that can be used to administer the SCoV-like-viral-associated antigens of the invention include liposomes containing immunostimulatory protein, cytokines, or T-cell and/or B-cell peptides, or microbes with or without entrapped IL-2 or microparticles containing enterotoxin. Other adjuvants known in the art are also included within the scope of the invention (see *Vaccine Design: The Subunit and Adjuvant Approach*, Chap. 7, Michael F. Powell and Mark J. Newman (eds.), Plenum Press, New York, 1995, which is incorporated herein in its entirety).

The effectiveness of an adjuvant may be determined by measuring the induction of antibodies directed against an immunogenic polypeptide containing a SCoV-like viral polypeptide epitope, the antibodies resulting from administration of this polypeptide in vaccines which are also comprised of the various adjuvants.

The polypeptides may be formulated into the vaccine as neutral or salt forms. Pharmaceutically acceptable salts include the acid additional salts (formed with free amino groups of the peptide) and which are formed with inorganic acids, such as, for example, hydrochloric or phosphoric acids, or organic acids such as acetic, oxalic, tartaric, maleic, and the like. Salts formed with free carboxyl groups may also be derived from inorganic bases, such as, for example, sodium potassium, ammonium, calcium, or ferric hydroxides, and such organic bases as isopropylamine, trimethylamine, 2-ethylamino ethanol, histidine, procaine and the like.

The vaccines of the invention may be multivalent or univalent. Multivalent vaccines are made from recombinant viruses that direct the expression of more than one antigen.

Many methods may be used to introduce the vaccine formulations of the invention; these include but are not limited to oral, intradermal, intramuscular, intraperitoneal, intravenous, subcutaneous, intranasal routes, and via scarification (scratching through the top layers of skin, e.g., using a bifurcated needle).

The patient to which the vaccine is administered is preferably a mammal, most preferably a human, but can also be a non-human animal including but not limited to cows, horses, sheep, pigs, fowl (e.g., chickens), goats, cats, dogs, hamsters, mice and rats.

5.5 Preparation of Antibodies

Antibodies which specifically recognize a polypeptide of the invention, such as, but not limited to, polypeptides comprising the sequence of SEQ ID NO:3, and polypeptides as shown in FIGS. 4, 5, and 7, or SCoV-like viral epitope or antigen-binding fragments thereof can be used for detecting, screening, and isolating the polypeptide of the invention or fragments thereof, or similar sequences that might encode similar enzymes from the other organisms. For example, in one specific embodiment, an antibody which immunospecifically binds SCoV-like viral epitope, or a fragment thereof, can be used for various in vitro detection assays, including enzyme-linked immunosorbent assays (ELISA), radioimmunoassays, Western blot, etc., for the detection of a polypeptide of the invention or, preferably, SCoV-like virus, in samples, for example, a biological material, including cells, cell culture media (e.g., bacterial cell culture media, mammalian cell culture media, insect cell culture media, yeast cell culture media, etc.), blood, plasma, serum, tissues, sputum, naseopharyngeal aspirates, etc.

Antibodies specific for a polypeptide of the invention or any epitope of SCoV-like virus may be generated by any suitable method known in the art. Polyclonal antibodies to an antigen-of-interest, for example, the SCoV-like virus or comprises a nucleic acid sequence of SEQ ID NO:1, 2, or 4 can be produced by various procedures well known in the art. For example, an antigen can be administered to various host animals including, but not limited to, rabbits, mice, rats, etc., to induce the production of antisera containing polyclonal antibodies specific for the antigen. Various adjuvants may be used to increase the immunological response, depending on the host species, and include but are not limited to, Freund's (complete and incomplete) adjuvant, mineral gels such as aluminum hydroxide, surface active substances such as lysolecithin, pluronic polyols, polyanions, peptides, oil emulsions, keyhole limpet hemocyanins, dinitrophenol, and potentially useful adjuvants for humans such as BCG (Bacille Calmette-Guerin) and *Corynebacterium parvum*. Such adjuvants are also well known in the art.

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., Antibodies: A Laboratory Manual, (Cold Spring Harbor Laboratory Press, 2nd ed. 1988); Hammerling, et al., in: Monoclonal Antibodies and T-Cell Hybridomas, pp. 563-681 (Elsevier, N.Y., 1981) (both of which are incorporated by reference in their entireties). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

Methods for producing and screening for specific antibodies using hybridoma technology are routine and well known in the art. In a non-limiting example, mice can be immunized with an antigen of interest or a cell expressing such an antigen. Once an immune response is detected, e.g., antibodies specific for the antigen are detected in the mouse serum, the mouse spleen is harvested and splenocytes isolated. The splenocytes are then fused by well known techniques to any suitable myeloma cells. Hybridomas are selected and cloned by limiting dilution. The hybridoma clones are then assayed by methods known in the art for cells that secrete antibodies capable of binding the antigen. Ascites fluid, which generally contains high levels of antibodies, can be generated by inoculating mice intraperitoneally with positive hybridoma clones.

Antibody fragments which recognize specific epitopes may be generated by known techniques. For example, Fab and F(ab')$_2$ fragments may be produced by proteolytic cleavage of immunoglobulin molecules, using enzymes such as papain (to produce Fab fragments) or pepsin (to produce F(ab')$_2$ fragments). F(ab')$_2$ fragments contain the complete light chain, and the variable region, the CH1 region and the hinge region of the heavy chain.

The antibodies of the invention or fragments thereof can be also produced by any method known in the art for the synthesis of antibodies, in particular, by chemical synthesis or preferably, by recombinant expression techniques.

The nucleotide sequence encoding an antibody may be obtained from any information available to those skilled in the art (i.e., from Genbank, the literature, or by routine cloning and sequence analysis). If a clone containing a nucleic acid encoding a particular antibody or an epitope-binding fragment thereof is not available, but the sequence of the antibody molecule or epitope-binding fragment thereof is known, a nucleic acid encoding the immunoglobulin may be chemically synthesized or obtained from a suitable source (e.g., an antibody cDNA library, or a cDNA library generated from, or nucleic acid, preferably poly A+ RNA, isolated from any tissue or cells expressing the antibody, such as hybridoma cells selected to express an antibody) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR may then be cloned into replicable cloning vectors using any method well known in the art.

Once the nucleotide sequence of the antibody is determined, the nucleotide sequence of the antibody may be manipulated using methods well known in the art for the manipulation of nucleotide sequences, e.g., recombinant DNA techniques, site directed mutagenesis, PCR, etc. (see, for example, the techniques described in Sambrook et al., supra; and Ausubel et al., eds., 1998, Current Protocols in Molecular Biology, John Wiley & Sons, NY, which are both incorporated by reference herein in their entireties), to generate antibodies having a different amino acid sequence by, for example, introducing amino acid substitutions, deletions, and/or insertions into the epitope-binding domain regions of the antibodies or any portion of antibodies which may enhance or reduce biological activities of the antibodies.

Recombinant expression of an antibody requires construction of an expression vector containing a nucleotide sequence that encodes the antibody. Once a nucleotide sequence encoding an antibody molecule or a heavy or light chain of an antibody, or portion thereof has been obtained, the vector for the production of the antibody molecule may be produced by recombinant DNA technology using techniques well known in the art as discussed in the previous sections. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The nucleotide sequence encoding the heavy-chain variable region, light-chain variable region, both the heavy-chain and light-chain variable regions, an epitope-binding fragment of the heavy- and/or light-chain variable region, or one or more complementarity determining regions (CDRs) of an antibody may be cloned into such a vector for expression. Thus-prepared expression vector can be then introduced into appropriate host cells for the expression of the antibody. Accordingly, the invention includes host cells containing a polynucleotide encoding an antibody specific for the polypeptides of the invention or fragments thereof.

The host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides or different selectable markers to ensure maintenance of both plasmids. Alternatively, a single vector may be used which encodes, and is capable of expressing, both heavy and light chain polypeptides. In such situations, the light chain should be placed before the heavy chain to avoid an excess of toxic free heavy chain (Proudfoot, Nature, 322:52, 1986; and Kohler, Proc. Natl. Acad. Sci. USA, 77:2 197, 1980). The coding sequences for the heavy and light chains may comprise cDNA or genomic DNA.

In another embodiment, antibodies can also be generated using various phage display methods known in the art. In phage display methods, functional antibody domains are displayed on the surface of phage particles which carry the polynucleotide sequences encoding them. In a particular embodiment, such phage can be utilized to display antigen binding domains, such as Fab and Fv or disulfide-bond stabilized Fv, expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage, including fd and M13. The antigen binding domains are expressed as a recombinantly fused protein to either the phage gene III or gene VIII protein. Examples of phage display methods that can be used to make the immunoglobulins, or fragments thereof, of the present invention include those disclosed in Brinkman et al., J. Immunol. Methods, 182:41-50, 1995; Ames et al., J. Immunol. Methods, 184: 177-186, 1995; Kettleborough et al., Eur. J. Immunol., 24:952-958, 1994; Persic et al., Gene, 187:9-18, 1997; Burton et al., Advances in Immunology, 57:191-280, 1994; PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

As described in the above references, after phage selection, the antibody coding regions from the phage can be isolated and used to generate whole antibodies, including human antibodies, or any other desired fragments, and expressed in any desired host, including mammalian cells, insect cells, plant cells, yeast, and bacteria, e.g., as described in detail below. For example, techniques to recombinantly produce Fab, Fab' and F(ab')2 fragments can also be employed using methods known in the art such as those disclosed in PCT publication WO 92/22324; Mullinax et al., BioTechniques, 12(6):864-869, 1992; and Sawai et al., AJRI, 34:26-34, 1995; and Better et al., Science, 240:1041-1043, 1988 (each of which is incorporated by reference in its entirety). Examples of techniques which can be used to produce single-chain Fvs and antibodies include those described in U.S. Pat. Nos. 4,946,778 and 5,258,498; Huston et al., Methods in Enzymology, 203:46-88, 1991; Shu et al., PNAS, 90:7995-7999, 1993; and Skerra et al., Science, 240:1038-1040, 1988.

Once an antibody molecule of the invention has been produced by any methods described above, it may then be purified by any method known in the art for purification of an immunoglobulin molecule, for example, by chromatography (e.g., ion exchange, affinity, particularly by affinity for the specific antigen after Protein A or Protein G purification, and sizing column chromatography), centrifugation, differential solubility, or by any other standard techniques for the purification of proteins. Further, the antibodies of the present invention or fragments thereof may be fused to heterologous polypeptide sequences described herein or otherwise known in the art to facilitate purification.

For some uses, including in vivo use of antibodies in humans and in vitro detection assays, it may be preferable to use chimeric, humanized, or human antibodies. A chimeric antibody is a molecule in which different portions of the antibody are derived from different animal species, such as antibodies having a variable region derived from a murine monoclonal antibody and a constant region derived from a human immunoglobulin. Methods for producing chimeric antibodies are known in the art. See e.g., Morrison, Science, 229:1202, 1985; Oi et al., BioTechniques, 4:214 1986; Gillies et al., J. Immunol. Methods, 125:191-202, 1989; U.S. Pat. Nos. 5,807,715; 4,816,567; and 4,816,397, which are incorporated herein by reference in their entireties. Humanized antibodies are antibody molecules from non-human species that bind the desired antigen having one or more complementarity determining regions (CDRs) from the non-human species and framework regions from a human immunoglobulin molecule. Often, framework residues in the human framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. See, e.g., Queen et al., U.S. Pat. No. 5,585,089; Riechmann et al., Nature, 332:323, 1988, which are incorporated herein by reference in their entireties. Antibodies can be humanized using a variety of techniques known in the art including, for example, CDR-grafting (EP 239,400; PCT publication WO 91/09967; U.S. Pat. Nos. 5,225,539; 5,530,101 and 5,585, 089), veneering or resurfacing (EP 592,106; EP 519,596; Padlan, Molecular Immunology, 28(4/5):489-498, 1991; Studnicka et al., Protein Engineering, 7(6):805-814, 1994; Roguska et al., Proc Natl. Acad. Sci. USA, 91:969-973, 1994), and chain shuffling (U.S. Pat. No. 5,565,332), all of which are hereby incorporated by reference in their entireties.

Completely human antibodies are particularly desirable for therapeutic treatment of human patients. Human antibodies can be made by a variety of methods known in the art including phage display methods described above using antibody libraries derived from human immunoglobulin sequences. See U.S. Pat. Nos. 4,444,887 and 4,716,111; and PCT publications WO 98/46645; WO 98/50433; WO 98/24893; WO 98/16654; WO 96/34096; WO 96/33735; and WO 91/10741, each of which is incorporated herein by reference in its entirety.

Human antibodies can also be produced using transgenic mice which are incapable of expressing functional endogenous immunoglobulins, but which can express human immunoglobulin genes. For an overview of this technology for producing human antibodies, see Lonberg and Huszar, Int. Rev. Immunol., 13:65-93, 1995. For a detailed discussion of this technology for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318;

5,885,793; 5,916,771; and 5,939,598, which are incorporated by reference herein in their entireties. In addition, companies such as Abgenix, Inc. (Fremont, Calif.), Medarex (NJ) and Genpharm (San Jose, Calif.) can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a mouse antibody, is used to guide the selection of a completely human antibody recognizing the same epitope. (Jespers et al., Bio/technology, 12:899-903, 1988).

Antibodies fused or conjugated to heterologous polypeptides may be used in in vitro immunoassays and in purification methods (e.g., affinity chromatography) well known in the art. See e.g., PCT publication Number WO 93/21232; EP 439,095; Naramura et al., Immunol. Lett., 39:91-99, 1994; U.S. Pat. No. 5,474,981; Gillies et al., PNAS, 89:1428-1432, 1992; and Fell et al., J. Immunol., 146:2446-2452, 1991, which are incorporated herein by reference in their entireties.

Antibodies may also be attached to solid supports, which are particularly useful for immunoassays or purification of the polypeptides of the invention or fragments, derivatives, analogs, or variants thereof, or similar molecules having the similar enzymatic activities as the polypeptide of the invention. Such solid supports include, but are not limited to, glass, cellulose, polyacrylamide, nylon, polystyrene, polyvinyl chloride or polypropylene.

5.6 Pharmaceutical Compositions and Kits

The present invention encompasses pharmaceutical compositions comprising anti-viral agents of the present invention. In a specific embodiment, the anti-viral agent is an antibody which immunospecifically binds and neutralize the SCoV-like virus or variants thereof, or any proteins derived therefrom. In another specific embodiment, the anti-viral agent is a polypeptide or nucleic acid molecule of the invention. The pharmaceutical compositions have utility as an anti-viral prophylactic agent and may be administered to a subject where the subject has been exposed or is expected to be exposed to a virus.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu and Wu, 1987, J. Biol. Chem. 262:4429 4432). Methods of introduction include but are not limited to intradermal, intramuscular, intraperitoneal, intravenous, subcutaneous, intranasal, epidural, and oral routes. The compounds may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In a preferred embodiment, it may be desirable to introduce the pharmaceutical compositions of the invention into the lungs by any suitable route. Pulmonary administration can also be employed, e.g., by use of an inhaler or nebulizer, and formulation with an aerosolizing agent.

In a specific embodiment, it may be desirable to administer the pharmaceutical compositions of the invention locally to the area in need of treatment; this may be achieved by, for example, and not by way of limitation, local infusion during surgery, topical application, e.g., in conjunction with a wound dressing after surgery, by injection, by means of a catheter, by means of a suppository, or by means of an implant, said implant being of a porous, non porous, or gelatinous material, including membranes, such as sialastic membranes, or fibers. In one embodiment, administration can be by direct injection at the site (or former site) infected tissues.

In another embodiment, the pharmaceutical composition can be delivered in a vesicle, in particular a liposome (see Langer, 1990, Science 249:1527-1533; Treat et al., in Liposomes in the Therapy of Infectious Disease and Cancer, Lopez Berestein and Fidler (eds.), Liss, New York, pp. 353-365 (1989); Lopez-Berestein, ibid., pp. 317-327; see generally ibid.).

In yet another embodiment, the pharmaceutical composition can be delivered in a controlled release system. In one embodiment, a pump may be used (see Langer, supra; Sefton, 1987, CRC Crit. Ref. Biomed. Eng. 14:201; Buchwald et al., 1980, Surgery 88:507; and Saudek et al., 1989, N. Engl. J. Med. 321:574). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J. Macromol. Sci. Rev. Macromol. Chem. 23:61 (1983); see also Levy et al., 1985, Science 228:190; During et al., 1989, Ann. Neurol. 25:351; Howard et al., 1989, J. Neurosurg. 71:105). In yet another embodiment, a controlled release system can be placed in proximity of the composition's target, i.e., the lung, thus requiring only a fraction of the systemic dose (see, e.g., Goodson, in Medical Applications of Controlled Release, supra, vol. 2, pp. 115-138 (1984)).

Other controlled release systems are discussed in the review by Langer (Science 249:1527-1533 (1990)).

The pharmaceutical compositions of the present invention comprise a therapeutically effective amount of an live attenuated, inactivated or killed SCoV-like virus, or recombinant or chimeric SCoV-like virus, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the pharmaceutical composition is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. The formulation should suit the mode of administration.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The pharmaceutical compositions of the invention can be formulated as neutral or salt forms. Pharmaceutically acceptable salts include those formed with free amino groups such as those derived from hydrochloric, phosphoric, acetic, oxalic, tartaric acids, etc., and those formed with free carboxyl groups such as those derived from sodium, potassium, ammonium, calcium, ferric hydroxides, isopropylamine, triethylamine, 2 ethylamino ethanol, histidine, procaine, etc.

The amount of the pharmaceutical composition of the invention which will be effective in the treatment of a particular disorder or condition will depend on the nature of the disorder or condition, and can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. However, suitable dosage ranges for intravenous administration are generally about 20 500 micrograms of active compound per kilogram body weight. Suitable dosage ranges for intranasal administration are generally about 0.01 pg/kg body weight to 1 mg/kg body weight. Effective doses may be extrapolated from dose response curves derived from in vitro or animal model test systems.

Suppositories generally contain active ingredient in the range of 0.5% to 10% by weight; oral formulations preferably contain 10% to 95% active ingredient.

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration. In a preferred embodiment, the kit contains an antiviral agent of the invention, e.g., an antibody specific for the polypeptides encoded by a nucleotide sequence of SEQ ID NO:1, 2 or 4, or as shown in FIGS. 4, 5 and 7, or any SCoV-like viral epitope, or a polypeptide or protein of the present invention, or a nucleic acid molecule of the invention, alone or in combination with adjuvants, antivirals, antibiotics, analgesic, bronchodialaters, or other pharmaceutically acceptable excipients.

The present invention further encompasses kits comprising a container containing a pharmaceutical composition of the present invention and instructions to for use.

5.7 Detection Assays

An exemplary method for detecting the presence or absence of a polypeptide or nucleic acid of the invention in a biological sample involves obtaining a biological sample from various sources and contacting the sample with a compound or an agent capable of detecting an epitope or nucleic acid (e.g., mRNA, genomic DNA) of the SCoV-like virus such that the presence of the SCoV-like virus is detected in the sample. A preferred agent for detecting SCoV-like viral mRNA or genomic RNA of the invention is a labeled nucleic acid probe capable of hybridizing to mRNA or genomic RNA encoding a polypeptide of the invention. The nucleic acid probe can be, for example, a nucleic acid molecule comprising or consisting of the nucleotide sequence or SEQ ID NO:1, 2, 4, or a portion thereof, such as an oligonucleotide of at least 15, 20, 25, 30, 50, 100, 250, 500, 750, 1,000 or more contiguous nucleotides in length and sufficient to specifically hybridize under stringent conditions to a SCoV-like viral mRNA or genomic RNA.

In another preferred specific embodiment, the presence of SCoV-like virus is detected in the sample by an reverse transcription polymerase chain reaction (RT-PCR) using the primers that are constructed based on a partial nucleotide sequence of the genome of SCoV-like virus. In a non-limiting specific embodiment, preferred primers to be used in a RT-PCR method comprises SEQ ID NO:5 and/or 6 in the presence of 2.5 mM $MgCl_2$ and the thermal cycles are, for example, but not limited to, 94° C. for 8 min followed by 40 cycles of 94° C. for 1 min, 50° C. for 1 min, 72° C. for 1 min. In more preferred specific embodiment, the present invention provides a real-time quantitative PCR assay to detect the presence of SCoV-like virus in a biological sample by subjecting the cDNA obtained by reverse transcription of the extracted total RNA from the sample to PCR reactions using the specific primers, such as those having nucleotide sequences of SEQ ID NOS:5 and/or 6, and a fluorescence dye, such as SYBR® Green I, which fluoresces when bound non-specifically to double-stranded DNA. The fluorescence signals from these reactions are captured at the end of extension steps as PCR product is generated over a range of the thermal cycles, thereby allowing the quantitative determination of the viral load in the sample based on an amplification plot.

A preferred agent for detecting SCoV-like virus is an antibody that specifically binds a polypeptide of the invention or any SCoV-like viral epitope, preferably an antibody with a detectable label. Antibodies can be polyclonal, or more preferably, monoclonal. An intact antibody, or a fragment thereof (e.g., Fab or F(ab')2) can be used.

The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin. The detection method of the invention can be used to detect mRNA, protein (or any epitope), or genomic RNA in a sample in vitro as well as in vivo. For example, in vitro techniques for detection of mRNA include northern hybridizations, in situ hybridizations, RT-PCR, and RNase protection. In vitro techniques for detection of an epitope of SCoV-like virus include enzyme linked immunosorbent assays (ELISAs), Western blots, immunoprecipitations and immunofluorescence. In vitro techniques for detection of genomic RNA include nothern hybridizations, RT-PCT, and RNase protection. Furthermore, in vivo techniques for detection of SCoV-like virus include introducing into a subject organism a labeled antibody directed against the polypeptide. For example, the antibody can be labeled with a radioactive marker whose presence and location in the subject organism can be detected by standard imaging techniques, including autoradiography.

In a specific embodiment, the methods further involve obtaining a control sample from a control subject, contacting the control sample with a compound or agent capable of detecting SCoV-like virus, e.g., a polypeptide of the invention or mRNA or genomic RNA encoding a polypeptide of the invention, such that the presence of SCoV-like virus or the polypeptide or mRNA or genomic RNA encoding the polypeptide is detected in the sample, and comparing the presence of SCoV-like virus or the polypeptide or mRNA or genomic RNA encoding the polypeptide in the control sample with the presence of SCoV-like virus, or the polypeptide or mRNA or genomic DNA encoding the polypeptide in the test sample.

The invention also encompasses kits for detecting the presence of SCoV-like virus or a polypeptide or nucleic acid of the invention in a test sample. The kit, for example, can comprise a labeled compound or agent capable of detecting SCoV-like virus or the polypeptide or a nucleic acid molecule encoding the polypeptide in a test sample and, in certain embodiments, a means for determining the amount of the polypeptide or mRNA in the sample (e.g., an antibody which binds the polypeptide or an oligonucleotide probe which binds to DNA or mRNA encoding the polypeptide). Kits can also include instructions for use.

For antibody-based kits, the kit can comprise, for example: (1) a first antibody (e.g., attached to a solid support) which binds to a polypeptide of the invention or SCoV-like viral epitope; and, optionally, (2) a second, different antibody which binds to either the polypeptide or the first antibody and is conjugated to a detectable agent.

For oligonucleotide-based kits, the kit can comprise, for example: (1) an oligonucleotide, e.g., a detectably labeled oligonucleotide, which hybridizes to a nucleic acid sequence encoding a polypeptide of the invention or to a sequence within the SCoV-like viral genome or (2) a pair of primers useful for amplifying a nucleic acid molecule containing an SCoV-like viral sequence. The kit can also comprise, e.g., a buffering agent, a preservative, or a protein stabilizing agent. The kit can also comprise components necessary for detecting the detectable agent (e.g., an enzyme or a substrate). The kit can also contain a control sample or a series of control samples which can be assayed and compared to the test sample contained. Each component of the kit is usually enclosed within an individual container and all of the various containers are within a single package along with instructions for use.

5.8 Screening Assays to Identify Anti-Viral Agents

The invention provides methods for the identification of a compound that inhibits the ability of SCoV-like virus to infect a host or a host cell. In certain embodiments, the invention provides methods for the identification of a compound that reduces the ability of SCoV-like virus to replicate in a host or a host cell. Any technique well-known to the skilled artisan can be used to screen for a compound that would abolish or reduce the ability of SCoV-like virus to infect a host and/or to replicate in a host or a host cell.

In certain embodiments, the invention provides methods for the identification of a compound that inhibits the ability of SCoV-like virus to replicate in a mammal or a mammalian cell. More specifically, the invention provides methods for the identification of a compound that inhibits the ability of SCoV-like virus to infect a mammal or a mammalian cell. In certain embodiments, the invention provides methods for the identification of a compound that inhibits the ability of SCoV-like virus to replicate in a mammalian cell. In a specific embodiment, the mammalian cell is a human cell.

In another embodiment, a cell is contacted with a test compound and infected with the SCoV-like virus. In certain embodiments, a control culture is infected with the SCoV-like virus in the absence of a test compound. The cell can be contacted with a test compound before, concurrently with, or subsequent to the infection with the SCoV-like virus. In a specific embodiment, the cell is a mammalian cell. In an even more specific embodiment, the cell is a human cell. In certain embodiments, the cell is incubated with the test compound for at least 1 minute, at least 5 minutes at least 15 minutes, at least 30 minutes, at least 1 hour, at least 2 hours, at least 5 hours, at least 12 hours, or at least 1 day. The titer of the virus can be measured at any time during the assay. In certain embodiments, a time course of viral growth in the culture is determined. If the viral growth is inhibited or reduced in the presence of the test compound, the test compound is identified as being effective in inhibiting or reducing the growth or infection of the SCoV-like virus. In a specific embodiment, the compound that inhibits or reduces the growth of the SCoV-like virus is tested for its ability to inhibit or reduce the growth rate of other viruses to test its specificity for the SCoV-like virus.

In one embodiment, a test compound is administered to a model animal and the model animal is infected with the SCoV-like virus. In certain embodiments, a control model animal is infected with the SCoV-like virus without the administration of a test compound. The test compound can be administered before, concurrently with, or subsequent to the infection with the SCoV-like virus. In a specific embodiment, the model animal is a mammal. In an even more specific embodiment, the model animal can be, but is not limited to, a cotton rat, a mouse, or a monkey. The titer of the virus in the model animal can be measured at any time during the assay. In certain embodiments, a time course of viral growth in the culture is determined. If the viral growth is inhibited or reduced in the presence of the test compound, the test compound is identified as being effective in inhibiting or reducing the growth or infection of the SCoV-like virus. In a specific embodiment, the compound that inhibits or reduces the growth of the SCoV-like virus in the model animal is tested for its ability to inhibit or reduce the growth rate of other viruses to test its specificity for the SCoV-like virus.

6. EXAMPLES

The following examples illustrate the isolation and identification of the novel hSARS virus. These examples should not be construed as limiting.

6.1 Materials and Methods

6.1.1 Sampling

Specimens were collected at a main food retail market, Dongmen Market, in Shenzhen, Guangdong Province. Nasal and faecal swabs were taken for each examined animal and blood was taken wherever possible. After collection, all swabs were kept in virus transport medium (Medium199) with antibiotics.

6.1.2 Virus Isolation and RT-PCR Diagnostic Test

Nasal and faecal swabs were screened by RT-PCR using a pair primers designed to amplify the N gene of SCoV Forward primer 5'-CAGCCCCAGATGGTACTTC-3' (SEQ ID NO:5)

Reverse primer 5'-TCTGCTTCCCTCTGCGTAC-3' (SEQ ID NO:6)

Nasal and faecal samples were cultured on faecal rhesus kidney (FRhK-4) cells for virus isolation as described. Peiris et al., 2003, Lancet 361:1319. Virus isolates were identified by RT-PCR followed by sequencing.

6.1.3 Neutralisation Assay

Animal sera were heat inactivated (56° C. for 30 minutes) and serially diluted from 1:20 to 1:640 and then mixed with 100 $TCID_{50}$ of the animal SCoV-like virus isolate SZ16. After incubation for 1 hour at 37° C., the mixture was inoculated in triplicate on to 96-well plates of FRhK-4 cell cultures. The results were read after 3 days incubation at 37° C.

6.1.4 Genetic Analysis

Viral RNA was extracted from the filtered supernatant of virus-infected FRhK-4 cells with the RNesay Mini Kit (Qiagen, Chatsworth, Calif.). A primer (5'-TTT TTT TTT TTT TTT GTG ATT-3') (SEQ ID NO:7) was designed for reverse transcription of viral RNA. Subsequently, polymerase chain reactions (PCR) were carried out using a series of primers prepared in our laboratory.

After purification of PCR products, cycling sequencing reactions were carried out to determine nucleotide sequence as reported. Guan et al., 2002, Proc. Natl. Acad. Sci. U.S.A. 99:8950. All sequence data were translated and analysed by Wisconsin Software Package, Version 10.1 (GCG). Phylogenetic relationship was determined using Clustal X 1.81 (Thompson et al., 1994, Nucleic Acids Res. 22:4673) and trees generated using Neighboring-Joining algorithms within PAUP, Version 4.0 (Genetics Computer Group, Madison, Wis.). Bootstrap scores are percentages out of 1000 replicates. Similar tree topologies were seen with Maximum Parsimony analysis.

6.2 Discussion

The isolation and identification of SCoV like viruses from animals has now confirmed the hypothesis that SCoV is of animal origin. Both phylogenetic and sequence analysis of SCoV-like viruses suggest that these animal viruses are closely related to human SCoV isolated in the early stage of SARS outbreak. These animal species are either the natural reservoir of SCoV, or an intermediate host that is important in its transmission of the virus to humans. There is a role of the Racoon-dog in the ecology of these viruses and that the Racoon-dog may be the reservoir or they themselves may have acquired it from other sources such as a palm civets.

The factors associated with the emergence of novel infectious diseases are diverse and include human population growth and mobility, global transportation, urban crowding, agriculture practice changes and rapid virus evolution. Holland et al., 1991, J. Viol. 65:1960; Domingo et al., 1997, Med Viol 7:87. The emergence of human H5N1 influenza viruses in 1997 (Jong et al., 1997, Nature 389:544; Subbarao et al., 1998, Science 279:393) and early 2003 (author unpublished data) were good examples to highlight some of these factors. The emergence of SARS in humans is another, even more dramatic example of this. Exotic animals wild caught or farmed meeting culinary demand may be a continued source of introduction of this SCoV to humans. The present invention will help to better understand the inter-species transmission events that lead to the SARS outbreak.

Both H5N1 influenza and SARS emerged in the hypothetical pandemic influenza epicenter of southern China. Shortridge et al., 1982, Lancet ii:812; Guan et al., 2002, Proc. Natl. Acad. Sci. U.S.A. 99:8950. In the case of H5N1, chickens were the immediate source of virus for humans (Shortridge et al., 1998, Virology 252:331) and the depopulation of chicken in the live poultry markets and farms in Hong Kong resulted in the interruption of the outbreak and possibly averted an influenza pandemic in humans. However, nearly half year since the emergence of SARS, the precursor SCoV-like viruses are still simmering in food markets of southern China. Thus the recognition of SCoV-like viruses in animals is of pivotal significance in the control of SARS. An immediate ban of wild-animal trading for food or other use is of the highest priority in the global fight against SARS.

7. EQUIVALENTS

Those skilled in the art will recognize, or be able to ascertain many equivalents to the specific embodiments of the invention described herein using no more than routine experimentation. Such equivalents are intended to be encompassed by the following claims.

All publications, patents and patent applications mentioned in this specification are herein incorporated by reference into the specification to the same extent as if each individual publication, patent or patent application was specifically and individually indicated to be incorporated herein by reference.

Citation or discussion of a reference herein shall not be construed as an admission that such is prior art to the present invention.

SEQUENCE LISTING (2464 sequences)

SEQ ID NO: 1 - DNA, 29 bp, Unknown
  Illustrative oligonucleotide
cctactggttaccaacctgaatggaatat

SEQ ID NO: 2 - DNA, 369 bp, SARS coronavirus-like virus
  CDS (1)..(366)
atgaaacttctcattgttttgacttgtatttctctatgcagttgcatacgcactgtagtacagcgctgtgcatctaataaacctcatgtgcttgaagatccttgtcctactggttaccaacctgaatggaatataaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaactaaacgaacaaattaa

SEQ ID NO: 3 - protein, 122 aa, SARS coronavirus-like virus
MKLLIVLTCISLCSCIRTVVQRCASNKPHVLEDPCPTGYQPEWNIRYNTRGNTYSTAWLCALGKVLPFHRWHTMVQTCTPNVTINCQDPAGGALIARCWYLHEGHQTAAFRDVLVVLTKRTN

SEQ ID NO: 4 - DNA, 29736 bp, Human severe acute respiratory syndrome virus
ctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatcctctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggcaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgtttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggagctcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaaaaa

SEQ ID NO: 5 - DNA, 20 bp, Artificial Sequence
  Primer
tcagccccagatggtacttc

SEQ ID NO: 6 - DNA, 20 bp, Artificial Sequence
  Primer
ctctgcttccctctgcgtac

SEQ ID NO: 7 - DNA, 21 bp, Artificial Sequence
  Primer
tttttttttttttttgtgatt

SEQ ID NO: 8 - protein, 39 aa, Human SARS coronavirus-like virus
MKLLIVLTCISLCSCICTVVQRCASNKPHVLEDPCKVQH

SEQ ID NO: 9 - protein, 84 aa, Human SARS coronavirus-like virus
MCLKILVRYNTRGNTYSTAWLCALGKVLPFHRWHTMVQTCTPNVTINCQDPAGGALIARCWYLHEGHQTAAFRDVLVVLNKRTN

SEQ ID NO: 10 - skipped

SEQ ID NO: 11 - DNA, 29736 bp, Human severe acute respiratory syndrome virus; identical to SEQ ID NO: 4
  CDS (1)..(29736)

SEQ ID NO: 12 - protein, 16 aa, Human severe acute respiratory syndrome virus
LPRKSQPTSISCRSVL

SEQ ID NO: 13 - protein, 14 aa, Human severe acute respiratory syndrome virus
TNFKICVAVARLHA

SEQ ID NO: 14 - protein, 5 aa, Human severe acute respiratory syndrome virus
CTYAV

SEQ ID NO: 15 - protein, 40 aa, Human severe acute respiratory syndrome virus
TIINFTVVDKKRVTRPSSADCLRFRPCCSRSSAYLGFVRV

SEQ ID NO: 16 - protein, 4386 aa, Human severe acute respiratory syndrome virus
PKGKMESLVLGVNEKTHVQLSLPVLQVRDVLVRGFGDSVEEALSEAREHLKNGTCGLVELEKGVLPQLEQPYVFIKRSDALSTNHGHKVVELVAEMDGIQYGRSGITLGVLVPHVGETPIAYRNVLLRKNGNKGAGGHSYGIDLKSYDLGDELGTDPIEDYEQNWNTKHGSGALRELTRELNGGAVTRYVDNNFCGPDGYPLDCIKDFLARAGKSMCTLSEQLDYIESKRGVYCCRDHEHEIAWFTERSDKSYEHQTPFEIKSAKKFDTFKGECPKFVFPLNSKVKVIQPRVEKKKTEGFMGRIRSVYPVASPQECNNMHLSTLMKCNHCDEVSWQTCDFLKATCEHCGTENLVIEGPTTCGYLPTNAVVKMPCPACQDPEIGPEHSVADYHNHSNIETRLRKGGRTRCFGGCVFAYVGCYNKRAYWVPRASADIGSGHTGITGDNVETLNEDLLEILSRERVNINIVGDFHLNEEVAIILASFSASTSAFIDTIKSLDYKSFKTIVESCGNYKVTKGKPVKGAWNIGQQRSVLTPLCGFPSQAAGVIRSIFARTLDAANHSIPDLQRAAVTILDGISEQSLRLVDAMVYTSDLLTNSVIIMAYVTGGLVQQTSQWLSNLLGTTVEKLRPIFEWIEAKLSAGVEFLKDAWEILKFLITGVFDIVKGQIQVASDNIKDCVKCFIDVVNKALEMCIDQVTIAGAKLRSLNLGEVFIAQSKGLYRQCIRGKEQLQLLMPLKAPKEVTFLEGDSHDTVLTSEEVVLKNGELEALETPVDSFTNGAIVGTPVCVNGLMLLEIKDKEQYCALSPGLLATNNVFRLKGGAPIKGVTFGEDTVWEVQGYKNVRITFELDERVDKVLNEKCSVYTVESGTEVTEFACVVAEAVVKTLQPVSDLLTNMGIDLDEWSVATFYLFDDAGEENFSSRMYCSFYPPDEEEEDDAECEEEEIDETCEHEYGTEDDYQGLPLEFGASAETVRVEEEEEEDWLDDTTEQSEIEPEPEPTPEEPVNQFTGYLKLTDNVAIKCVDIVKEAQSANPMVIVNAANIHLKHGGGVAGALNKATNGAMQKESDDYIKLNGPLTVGGSCLLSGHNLAKKCLHVVGPNLNAGEDIQLLKAAYENFNSQDILLAPLLSAGIFGAKPLQSLQVCVQTVRTQVYIAVNDKALYEQVVMDYLDNLKPRVEAPKQEEPPNTEDSKTEEKSVVQKPVDVKPKIKACIDEVTTTLEETKFLTNKLLLFADINGKLYHDSQNMLRGEDMSFLEKDAPYMVGDVITSGDITCVVIPSKKAGGTTEMLSRALKKVPVDEYITTYPGQGCAGYTLEEAKTALKKCKSAFYVLPSEAPNAKEEILGTVSWNLREMLAHAEETRKLMPICMDVRAIMATIQRKYKGIKIQEGIVDYGVRFFFYTSKEPVASIITKLNSLNEPLVTMPIGYVTHGFNLEEAARCMRSLKAPAVVSVSSPDAVTTYNGYLTSSSKTSEEHFVETVSLAGSYRDWSYSGQRTELGVEFLKRGDKIVYHTLESPVEFHLDGEVLSLDKLKSLLSLREVKTIKVFTTVDNTNLHTQLVDMSMTYGQQFGPTYLDGADVTKIKPHVNHEGKTFFVLPSDDTLRSEAFEYYHTLDESFLGRYMSALNHTKKWKFPQVGGLTSIKWADNNCYLSSVLLALQQLEVKFNAPALQEAYYRARAGDAANFCALILAYSNKTVGELGDVRETMTHLLQHANLESAKRVLNVVCKHCGQKTTTLTGVEAVMYMGTLSYDNLKTGVSIPCVCGRDATQYLVQQESSFVMMSAPPAEYKLQQGTFLCANEYTGNYQCGHYTHITAKETLYRIDGAHLTKMSEYKGPVTDVFYKETSYTTTIKPVSYKLDGVTYTEIEPKLDGYYKKDNAYYTEQPIDLVPTQPLPNASFDNFKLTCSNTKFADDLNQMTGFTKPASRELSVTFFPDLNGDVVAIDYRHYSASFKKGAKLLHKPIVWHINQATTKTTFKPNTWCLRCLWSTKPVDTSNSFEVLAVEDTQGMDNLACESQQPTSEEVVENPTIQKEVIECDVKTTEVVGNVILKPSDEGVKVTQELGHEDLMAAYVENTSITIKKPNELSLALGLKTIATHGIAAINSVPWSKILAYVKPFLGQAAITTSNCAKRLAQRVFNNYMPYVFTLLFQLCTFTKSTNSRIRASLPTTIAKNSVKSVAKLCLDAGINYVKSPKFSKLFTIAMWLLLLSICLGSLICVTAAFGVLLSNFGAPSYCNGVRELYLNSSNVTTMDFCEGSFPCSICLSGLDSLDSYPALETIQVTISSYKLDLTILGLAAEWVLAYMLFTKFFYLLGLSAIMQVFFGYFASHFISNSWLMWFIISIVQMAPVSAMVRMYIFFASFYYIWKSYVHIMDGCTSSTCMMCYKRNRATRVECTTIVNGMKRSFYVYANGGRGFCKTHNWNCLNCDTFCTGSTFISDEVARDLSLQFKRPINPTDQSSYIVDSVAVKNGALHLYFDKAGQKTYERHPLSHFVNLDNLRANNTKGSLPINVIVFDGKSKCDESASKSASVYYSQLMCQPILLLDQALVSDVGDSTEVSVKMFDAYVDTFSATFSVPMEKLKALVATAHSELAKGVALDGVLSTFVSAARQGVVDTDVDTKDVIECLKLSHHSDLEVTGDSCNNFMLTYNKVENMTPRDLGACIDCNARHINAQVAKSHNVSLIWNVKDYMSLSEQLRKQIRSAAKKNNIPFRLTCATTRQVVNVITTKISLKGGKIVSTCFKLMLKATLLCVLAALVCYIVMPVHTLSIHDGYTNEIIGYKAIQDGVTRDIISTDDCFANKHAGFDAWFSQRGGSYKNDKSCPVVAAIITREIGFIVPGLPGTVLRAINGDFLHFLPRVFSAVGNICYTPSKLIEYSDFATSACVLAAECTIFKDAMGKPVPYCYDTNLLEGSISYSELRPDTRYVLMDGSIIQFPNTYLEGSVRVVTTFDAEYCRHGTCERSEVGICLSTSGRWVLNNEHYRALSGVFCGVDAMNLIANIFTPLVQPVGALDVSASVVAGGIIAILVTCAAYYFMKFRRAFGEYNHVVAANALLFLMSFTILCLAPAYSFLPGVYSVFYLYLTFYFTNDVSFLAHLQWFAMFSPIVPFWITAIYVFCISLKHCHWFFNNYLRKRVMFNGVTFSTFEEAALCTFLLNKEMYLKLRSETLLPLTQYNRYLALYNKYKYFSGALDTTSYREAACCHLAKALNDFSNSGADVLYQPPQTSITSAVLQSGFRKMAFPSGKVEGCMVQVTCGTTTLNGLWLDDTVYCPRHVICTAEDMLNPNYEDLLIRKSNHSFLVQAGNVQLRVIGHSMQNCLLRLKVDTSNPKTPKYKFVRIQPGQTFSVLACYNGSPSGVYQCAMRPNHTIKGSFLNGSCGSVGFNIDYDCVSFCYMHHMELPTGVHAGTDLEGKFYGPFVDRQTAQAAGTDTTITLNVLAWLYAAVINGDRWFLNRFTTTLNDFNLVAMKYNYEPLTQDHVDILGPLSAQTGIAVLDMCAALKELLQNGMNGRTILGSTILEDEFTPFDVVRQCSGVTFQGKFKKIVKGTHHWMLLTFLTSLLILVQSTQWSLFFFVYENAFLPFTLGIMAIAACAMLLVKHKHAFLCLFLLPSLATVAYFNMVYMPASWVMRIMTWLELADTSLSGYRLKDCVMYASALVLLILMTARTVYDDAARRVWTLMNVITLVYKVYYGNALDQAISMWALVISVTSNYSGVVTTIMFLARAIVFVCVEYYPLLFITGNTLQCIMLVYCFLGYCCCCYFGLFCLLNRYFRLTLGVYDYLVSTQEFRYMNSQGLLPPKSSIDAFKLNIKLLGIGGKPCIKVATVQSKMSDVKCTSVVLLSVLQQLRVESSSKLWAQCVQLHNDILLAKDTTEAFEKMVSLLSVLLSMQGAVDINRLCEEMLDNRATLQAIASEFSSLPSYAAYATAQEAYEQAVANGDSEVVLKKLKKSLNVAKSEFDRDAAMQRKLEKMADQAMTQMYKQARSEDKRAKVTSAMQTMLFTMLRKLDNDALNNIINNARDGCVPLNIIPLTTAAKLMVVVPDYGTYKNTCDGNTFTYASALWEIQQVVDADSKIVQLSEINMDNSPNLAWPLIVTALRANSAVKLQNNELSPVALRQMSCAAGTTQTACTDDNALAYYNNSKGGRFVLALLSDHQDLKWARFPKSDGTGTIYTELEPPCRFVTDTPKGPKVKYLYFIKGLNNLNRGMVLGSLAATVRLQAGNATEVPANSTVLSFCAFAVDPAKAYKDYLASGGQPITNCVKMLCTHTGTGQAITVTPEANMDQESFGGASCCLYCRCHIDHPNPKGFCDLKGKYVQIPTTCANDPVGFTLRNTVCTVCGMWKGYGCSCDQLREPLMQSADASTFLNGFAV

SEQ ID NO: 17 - protein, 34 aa, Human severe acute respiratory syndrome virus
VQPVLHRAAQALVLMSSTGLLIFTTKKLLVLQSS

SEQ ID NO: 18 - protein, 16 aa, Human severe acute respiratory syndrome virus
KLIAVASRRRMRKAIY

SEQ ID NO: 19 - protein, 4 aa, Human severe acute respiratory syndrome virus
TLTL

SEQ ID NO: 20 - protein, 34 aa, Human severe acute respiratory syndrome virus
LRGILCLTTNMKRLFITWLKIVQRLLSMTFSSLE

SEQ ID NO: 21 - protein, 12 aa, Human severe acute respiratory syndrome virus
MVTWYHIYHVSV

SEQ ID NO: 22 - protein, 7 aa, Human severe acute respiratory syndrome virus
LNTQWLI

SEQ ID NO: 23 - protein, 14 aa, Human severe acute respiratory syndrome virus
SMLYVILMRVIVIH

SEQ ID NO: 24 - protein, 23 aa, Human severe acute respiratory syndrome virus
KKYSSHTIAVMMIISIRRIGMTS

SEQ ID NO: 25 - protein, 11 aa, Human severe acute respiratory syndrome virus
RILTSYAYMLT

SEQ ID NO: 26 - protein, 8 aa, Human severe acute respiratory syndrome virus
VSVYANHY

SEQ ID NO: 27 - protein, 14 aa, Human severe acute respiratory syndrome virus
RLYNSAMLCVMQAL

SEQ ID NO: 28 - protein, 17 aa, Human severe acute respiratory syndrome virus
IIRILMGTGTISVISYK

SEQ ID NO: 29 - protein, 15 aa, Human severe acute respiratory syndrome virus
HQAAEFLLWIHITHC

SEQ ID NO: 30 - protein, 5 aa, Human severe acute respiratory syndrome virus
CPSSL

SEQ ID NO: 31 - protein, 23 aa, Human severe acute respiratory syndrome virus
LGHWLLSPIWMLISQNHLLSGIC

SEQ ID NO: 32 - protein, 57 aa, Human severe acute respiratory syndrome virus
NMILRKRDFVSSTVILNIGTRHTIPIVLTVWMIGVSFIVQTLMCYFLLCFHLQVLDH

SEQ ID NO: 33 - protein, 4 aa, Human severe acute respiratory syndrome virus
EKYL

SEQ ID NO: 34 - protein, 15 aa, Human severe acute respiratory syndrome virus
MVFLLLFQLDTIFVS

SEQ ID NO: 35 - protein, 7 aa, Human severe acute respiratory syndrome virus
ESYIIRM

SEQ ID NO: 36 - protein, 12 aa, Human severe acute respiratory syndrome virus
TYIARVSVSRNF

SEQ ID NO: 37 - protein, 16 aa, Human severe acute respiratory syndrome virus
CMLLIQLCMQLLAIYC

SEQ ID NO: 38 - protein, 8 aa, Human severe acute respiratory syndrome virus
INALHAFQ

SEQ ID NO: 39 - protein, 35 aa, Human severe acute respiratory syndrome virus
QTMLLFKLSNPVILIKTFMTLLCLKVSLRKEVLLN

SEQ ID NO: 40 - protein, 34 aa, Human severe acute respiratory syndrome virus
NTSSLLRMATLLSVIMTIIVIICQQCVISDNSYS

SEQ ID NO: 41 - protein, 20 aa, Human severe acute respiratory syndrome virus
LKLLINTLIVTMVAVLMPTK

SEQ ID NO: 42 - protein, 25 aa, Human severe acute respiratory syndrome virus
SLTIWINQLVSHLINGVRLDFIMTQ

SEQ ID NO: 43 - protein, 19 aa, Human severe acute respiratory syndrome virus
VMRIKMHFSRILSVMSSLL

SEQ ID NO: 44 - protein, 14 aa, Human severe acute respiratory syndrome virus
ILSMPLVQRIELAP

SEQ ID NO: 45 - protein, 8 aa, Human severe acute respiratory syndrome virus
LVSLSVVL

SEQ ID NO: 46 - protein, 9 aa, Human severe acute respiratory syndrome virus
QIDSFIRNY

SEQ ID NO: 47 - protein, 8 aa, Human severe acute respiratory syndrome virus
PPLEELLW

SEQ ID NO: 48 - protein, 13 aa, Human severe acute respiratory syndrome virus
LEQASFTVAGIIC

SEQ ID NO: 49 - protein, 6 aa, Human severe acute respiratory syndrome virus
KLFTVM

SEQ ID NO: 50 - protein, 22 aa, Human severe acute respiratory syndrome virus
KLHTLWVGIIQNVTEPCLTCLG

SEQ ID NO: 51 - protein, 22 aa, Human severe acute respiratory syndrome virus
WPLLFLLANITLAVTYHTVSTG

SEQ ID NO: 52 - protein, 7 aa, Human severe acute respiratory syndrome virus
LTSVRKY

SEQ ID NO: 53 - protein, 40 aa, Human severe acute respiratory syndrome virus
VRWSCVAAHYMLNQVEHHPVMLQLLMLIVSLTFVKLLQPM

SEQ ID NO: 54 - protein, 10 aa, Human severe acute respiratory syndrome virus
MHFFQLMVIR

SEQ ID NO: 55 - protein, 39 aa, Human severe acute respiratory syndrome virus
LTSMSAIYNTGSMSVSIEIGMLIMNSWMSFTLTCVNISP

SEQ ID NO: 56 - protein, 18 aa, Human severe acute respiratory syndrome virus
FFLMMPLCAITVTMRLKV

SEQ ID NO: 57 - protein, 42 aa, Human severe acute respiratory syndrome virus
LALRTLRQFFIIKIMCSCLRQNVGLRLTLLKDLTNFAHSIQC

SEQ ID NO: 58 - protein, 18 aa, Human severe acute respiratory syndrome virus
LNKEMITCTCLTQIHQEY

SEQ ID NO: 59 - protein, 16 aa, Human severe acute respiratory syndrome virus
AQAVLSMILSKQMVHL

SEQ ID NO: 60 - protein, 49 aa, Human severe acute respiratory syndrome virus
LKGSCHWLLMLTHLQNILIRSMLMSFTCIYNTLESYMMSLLATCWTCIP

SEQ ID NO: 61 - protein, 26 aa, Human severe acute respiratory syndrome virus
LMITPHGTGNLSFMRLCTHHIQSCRL

SEQ ID NO: 62 - protein, 38 aa, Human severe acute respiratory syndrome virus
VLVYCAIHRLHFVAVPVLGDHSYVASAAMTMSFQHHTN

SEQ ID NO: 63 - protein, 18 aa, Human severe acute respiratory syndrome virus
CCLLIPMFAMPQVVMSLM

SEQ ID NO: 64 - protein, 4 aa, Human severe acute respiratory syndrome virus
HNCI

SEQ ID NO: 65 - protein, 29 aa, Human severe acute respiratory syndrome virus
AIIASHISLPLVFHYVLMVRFLVYTKTHV

SEQ ID NO: 66 - protein, 10 aa, Human severe acute respiratory syndrome virus
AVTMSLTSMR

SEQ ID NO: 67 - protein, 66 aa, Human severe acute respiratory syndrome virus
QHVIGLMLAITYLPTLVLRDSSFSQQKRSKPLRKHLSCHMVLPLYAKYSLTENCIFHGRLENLDHH

SEQ ID NO: 68 - protein, 10 aa, Human severe acute respiratory syndrome virus
TETMSLLVTV

SEQ ID NO: 69 - protein, 31 aa, Human severe acute respiratory syndrome virus
LKIVKYRLESTPLKKVTMVMLLCTEVLRHTS

SEQ ID NO: 70 - protein, 7 aa, Human severe acute respiratory syndrome virus
MLVITLC

SEQ ID NO: 71 - protein, 4 aa, Human severe acute respiratory syndrome virus
HLTL

SEQ ID NO: 72 - protein, 7 aa, Human severe acute respiratory syndrome virus
CHLVHLL

SEQ ID NO: 73 - protein, 6 aa, Human severe acute respiratory syndrome virus
CHKSTM

SEQ ID NO: 74 - protein, 56 aa, Human severe acute respiratory syndrome virus
ELLACTQHSTSQMSFLAMLQIIKRSACKSTLHSKDHLVLVRVILPSDLLSITHLLA

SEQ ID NO: 75 - protein, 17 aa, Human severe acute respiratory syndrome virus
CIRHALMQLLMPYVKRH

SEQ ID NO: 76 - protein, 4 aa, Human severe acute respiratory syndrome virus
NICP

SEQ ID NO: 77 - protein, 12 aa, Human severe acute respiratory syndrome virus
INVVESYLRVRA

SEQ ID NO: 78 - protein, 7 aa, Human severe acute respiratory syndrome virus
SVLINSK

SEQ ID NO: 79 - protein, 7 aa, Human severe acute respiratory syndrome virus
NSMFSAL

SEQ ID NO: 80 - protein, 10 aa, Human severe acute respiratory syndrome virus
MHCQKQLLTL

SEQ ID NO: 81 - protein, 12 aa, Human severe acute respiratory syndrome virus
SLMKSLWLLIMT

SEQ ID NO: 82 - protein, 27 aa, Human severe acute respiratory syndrome virus
VLSMLDFVQNTTSILAILLNYQPPAHC

SEQ ID NO: 83 - protein, 4 aa, Human severe acute respiratory syndrome virus
LKAH

SEQ ID NO: 84 - protein, 11 aa, Human severe acute respiratory syndrome virus
NQNILIQCADL

SEQ ID NO: 85 - protein, 19 aa, Human severe acute respiratory syndrome virus
VQTCSLELVAVVLLKLLTL

SEQ ID NO: 86 - protein, 5 aa, Human severe acute respiratory syndrome virus
FMTIS

SEQ ID NO: 87 - protein, 31 aa, Human severe acute respiratory syndrome virus
KHTRRSQLNASKCSTKVLLHMMFHLQSTDLK

SEQ ID NO: 88 - protein, 24 aa, Human severe acute respiratory syndrome virus
ENFLHAILLGEKLFLSHLIIHRTL

SEQ ID NO: 89 - protein, 4 aa, Human severe acute respiratory syndrome virus
LQKS

SEQ ID NO: 90 - protein, 48 aa, Human severe acute respiratory syndrome virus
DCLRRLLIHHRVLNMTMSYSHKLLKQHTLVMSTVSMWLSQGQKLAFCA

SEQ ID NO: 91 - protein, 14 aa, Human severe acute respiratory syndrome virus
CLIEIFMTNCNLQV

SEQ ID NO: 92 - protein, 14 aa, Human severe acute respiratory syndrome virus
KYHVAMWLHYKQKM

SEQ ID NO: 93 - protein, 26 aa, Human severe acute respiratory syndrome virus
LDFLRTVVRSLLVFILHRHLHTSALI

SEQ ID NO: 94 - protein, 17 aa, Human severe acute respiratory syndrome virus
SSRLKDYVLTYQAYQRT

SEQ ID NO: 95 - protein, 7 aa, Human severe acute respiratory syndrome virus
PTVDSSL

SEQ ID NO: 96 - protein, 4 aa, Human severe acute respiratory syndrome virus
WVSK

SEQ ID NO: 97 - protein, 28 aa, Human severe acute respiratory syndrome virus
ITKSMVTLICLSPAKKLFVTFVRGLALM

SEQ ID NO: 98 - protein, 17 aa, Human severe acute respiratory syndrome virus
RAVMQLEMLWVLTYLSS

SEQ ID NO: 99 - protein, 7 aa, Human severe acute respiratory syndrome virus
DFLQVLT

SEQ ID NO: 100 - protein, 42 aa, Human severe acute respiratory syndrome virus
LYRLVMLTLKITQNSPELMQNLHQVTSLNILYHSCIKACPGM

SEQ ID NO: 101 - protein, 4 aa, Human severe acute respiratory syndrome virus
CVLR

SEQ ID NO: 102 - protein, 7 aa, Human severe acute respiratory syndrome virus
YKCSVIH

SEQ ID NO: 103 - protein, 20 aa, Human severe acute respiratory syndrome virus
KDCQTESCSSFGRMALSLHQ

SEQ ID NO: 104 - protein, 45 aa, Human severe acute respiratory syndrome virus
STLSRLDLKERVVCVTNVQLAFLLHQILMPAGIILWVLTMSITHL

SEQ ID NO: 105 - protein, 34 aa, Human severe acute respiratory syndrome virus
LMFSSGALRVTFRVTMTNIARYMEMHMWLVVMLS

SEQ ID NO: 106 - protein, 18 aa, Human severe acute respiratory syndrome virus
QSMSALLSALIGLLNTLL

SEQ ID NO: 107 - protein, 13 aa, Human severe acute respiratory syndrome virus
GLILLAEKYNTWL

SEQ ID NO: 108 - protein, 28 aa, Human severe acute respiratory syndrome virus
SLHCLLISFQFFMTLEIQRLSSVCLRLK

SEQ ID NO: 109 - protein, 16 aa, Human severe acute respiratory syndrome virus
NGSSTMLSHVVTKLTK

SEQ ID NO: 110 - protein, 45 aa, Human severe acute respiratory syndrome virus
RSSSILMLHITINSLMVFVCFGIVTLIVTQPMQLCVGLTQESCQT

SEQ ID NO: 111 - protein, 11 aa, Human severe acute respiratory syndrome virus
TYQAVMVVVCM

SEQ ID NO: 112 - protein, 17 aa, Human severe acute respiratory syndrome virus
ISMHSTLQLSIKVHLLI

SEQ ID NO: 113 - protein, 19 aa, Human severe acute respiratory syndrome virus
SNCLSFTILIVLVSLMANK

SEQ ID NO: 114 - protein, 19 aa, Human severe acute respiratory syndrome virus
CRILIMFHSNLLRVLHDAI

SEQ ID NO: 115 - protein, 20 aa, Human severe acute respiratory syndrome virus
VVLFADTMQMSTDSTWMHII

SEQ ID NO: 116 - protein, 27 aa, Human severe acute respiratory syndrome virus
FLLDLAYGFTNNLILITCGIHLPGYRV

SEQ ID NO: 117 - protein, 32 aa, Human severe acute respiratory syndrome virus
KMWLIMLLIKDTLMDTPAKHLFPSLIMLFTQR

SEQ ID NO: 118 - protein, 48 aa, Human severe acute respiratory syndrome virus
MVLMWRSLKIRQHFLLMLHLSFGLSVTLNQCQRLRYSIIWVLISLLIL

SEQ ID NO: 119 - protein, 14 aa, Human severe acute respiratory syndrome virus
SGTTKEKPQHMYLQ

SEQ ID NO: 120 - protein, 4 aa, Human severe acute respiratory syndrome virus
VSAQ

SEQ ID NO: 121 - protein, 26 aa, Human severe acute respiratory syndrome virus
LTLPRNLLRVLVLHLLSCLMVEWKDR

SEQ ID NO: 122 - protein, 10 aa, Human severe acute respiratory syndrome virus
TFLETPVMVF

SEQ ID NO: 123 - protein, 7 aa, Human severe acute respiratory syndrome virus
QKVQSKV

SEQ ID NO: 124 - protein, 15 aa, Human severe acute respiratory syndrome virus
HLQRDQHKLASMESH

SEQ ID NO: 125 - protein, 4 aa, Human severe acute respiratory syndrome virus
LENQ

SEQ ID NO: 126 - protein, 9 aa, Human severe acute respiratory syndrome virus
KHSLTTLRK

SEQ ID NO: 127 - protein, 17 aa, Human severe acute respiratory syndrome virus
TALFNSCLKPTLLRAET

SEQ ID NO: 128 - protein, 49 aa, Human severe acute respiratory syndrome virus
RILSPDHKWKLTFSSSLWMNSYSDISSRAMPSNTSFMEISVMDNLAVFI

SEQ ID NO: 129 - protein, 10 aa, Human severe acute respiratory syndrome virus
PSAHKIHHLN

SEQ ID NO: 130 - protein, 9 aa, Human severe acute respiratory syndrome virus
RILSLWTAQ

SEQ ID NO: 131 - protein, 4 aa, Human severe acute respiratory syndrome virus
KITS

SEQ ID NO: 132 - protein, 13 aa, Human severe acute respiratory syndrome virus
QMRKQVHQNVCVL

SEQ ID NO: 133 - protein, 10 aa, Human severe acute respiratory syndrome virus
LIFYLMTLSR

SEQ ID NO: 134 - protein, 6 aa, Human severe acute respiratory syndrome virus
SHKICQ

SEQ ID NO: 135 - protein, 72 aa, Human severe acute respiratory syndrome virus
FQKWSRLQLTMLKFHSCFGVRMDMLKPSTQNYKQVKRGNQVLRCLTCTRCKECFLKSVTFRIMVKMLLYQKE

SEQ ID NO: 136 - protein, 11 aa, Human severe acute respiratory syndrome virus
MSQSILNCVNT

SEQ ID NO: 137 - protein, 4 aa, Human severe acute respiratory syndrome virus
IHLL

SEQ ID NO: 138 - protein, 5 aa, Human severe acute respiratory syndrome virus
LYPTT

SEQ ID NO: 139 - protein, 45 aa, Human severe acute respiratory syndrome virus
ELFTLVLALIKELHQVQLCSDNGCQLAHYLSIQILMTSSPTQILL

SEQ ID NO: 140 - protein, 27 aa, Human severe acute respiratory syndrome virus
LETVQQYIRLINGTLLLAICMTLGPNM

SEQ ID NO: 141 - protein, 17 aa, Human severe acute respiratory syndrome virus
QKRMTLKKGFSLICVDL

SEQ ID NO: 142 - protein, 5 aa, Human severe acute respiratory syndrome virus
PWVVL

SEQ ID NO: 143 - protein, 25 aa, Human severe acute respiratory syndrome virus
QSILGMLTFTSLWAISHGGQLLLQM

SEQ ID NO: 144 - protein, 8 aa, Human severe acute respiratory syndrome virus
MHHHRKHF

SEQ ID NO: 145 - protein, 40 aa, Human severe acute respiratory syndrome virus
LGLTILASRRNKLMAIPCMLTTFSGGTQILSSCLPIHSLT

SEQ ID NO: 146 - protein, 6 aa, Human severe acute respiratory syndrome virus
ANFLLN

SEQ ID NO: 147 - protein, 4 aa, Human severe acute respiratory syndrome virus
EELL

SEQ ID NO: 148 - protein, 10 aa, Human severe acute respiratory syndrome virus
CLLRRIKSMI

SEQ ID NO: 149 - protein, 67 aa, Human severe acute respiratory syndrome virus
FILFWKKVGLSLEKTTELWFQVIFLLTTKRTCLFSYYFLLSLVVVTLTGAPLLMMFKLLITLNILHL

SEQ ID NO: 150 - protein, 16 aa, Human severe acute respiratory syndrome virus
GGFTILMKFLDQTLFI

SEQ ID NO: 151 - protein, 52 aa, Human severe acute respiratory syndrome virus
LRIYFFHFILMLQGFILLIIRLTTLSYLLRMVFILLPQRNQMLSVVGFLVLP

SEQ ID NO: 152 - protein, 6 aa, Human severe acute respiratory syndrome virus
TTSHSR

SEQ ID NO: 153 - protein, 36 aa, Human severe acute respiratory syndrome virus
LLLTILLMLLYEHVTLNCVTTLSLLFLNPWVHRHIL

SEQ ID NO: 154 - protein, 51 aa, Human severe acute respiratory syndrome virus
YSIMHLIALSSTYLMPFRLMFQKSQVILNTYESLCLKIKMGFSMFIRAINL

SEQ ID NO: 155 - protein, 10 aa, Human severe acute respiratory syndrome virus
FVIYLLVLTL

SEQ ID NO: 156 - protein, 40 aa, Human severe acute respiratory syndrome virus
NLFLSCLLVLTLQILEPFLQPFHLLKTLGARQLQPILLAI

SEQ ID NO: 157 - protein, 56 aa, Human severe acute respiratory syndrome virus
SQLHLCSSMMKMVQSQMLLIVLKIHLLNSNALLRALRLTKEFTRPLISGLFPQEML

SEQ ID NO: 158 - protein, 59 aa, Human severe acute respiratory syndrome virus
DSLILQTCVLLERFLMLLNSLLSMHGREKKFLIVLLITLCSTTQHFFQPLSAMAFLPLS

SEQ ID NO: 159 - protein, 13 aa, Human severe acute respiratory syndrome virus
MIFASPMSMQILL

SEQ ID NO: 160 - protein, 5 aa, Human severe acute respiratory syndrome virus
SREMM

SEQ ID NO: 161 - protein, 80 aa, Human severe acute respiratory syndrome virus
RQDKLVLLLIIIINCQMISWVVSLLGILGTLMLLQLVIIIINIGILDMASLGPLRETYLMCLSPLMANLAPHLLLIVIGH

SEQ ID NO: 162 - protein, 18 aa, Human severe acute respiratory syndrome virus
MIMVFTPLLALATNLTEL

SEQ ID NO: 163 - protein, 6 aa, Human severe acute respiratory syndrome virus
YFLLNF

SEQ ID NO: 164 - protein, 33 aa, Human severe acute respiratory syndrome virus
MHRPRFVDQNYPLTLLRTSVSILILMDSLVLVC

SEQ ID NO: 165 - protein, 32 aa, Human severe acute respiratory syndrome virus
LLLQRDFNHFNNLAVMFLISLIPFEILKHLKY

SEQ ID NO: 166 - protein, 9 aa, Human severe acute respiratory syndrome virus
TFHLALLGV

SEQ ID NO: 167 - protein, 53 aa, Human severe acute respiratory syndrome virus
LHLEQMLHLKLLFYIKMLTALMFLQQFMQINSHQLGAYILLETMYSRLKQAVL

SEQ ID NO: 168 - protein, 43 aa, Human severe acute respiratory syndrome virus
ELSMSTLLMSATFLLELAFVLVTIQFLYYVVLAKNLLWLILCL

SEQ ID NO: 169 - protein, 26 aa, Human severe acute respiratory syndrome virus
VLIVQLLTLITPLLYLLTFQLALLQK

SEQ ID NO: 170 - protein, 9 aa, Human severe acute respiratory syndrome virus
CLFLWLKPP

SEQ ID NO: 171 - protein, 26 aa, Human severe acute respiratory syndrome virus
IVICTSAEILLNVLICFSNMVAFAHN

SEQ ID NO: 172 - protein, 30 aa, Human severe acute respiratory syndrome virus
IVHSQVLLLNRIATHVKCSLKSNKCTKPQL

SEQ ID NO: 173 - protein, 15 aa, Human severe acute respiratory syndrome virus
NILVVLIFHKYYLTL

SEQ ID NO: 174 - protein, 15 aa, Human severe acute respiratory syndrome virus
SQLRGLLLRTCSLIR

SEQ ID NO: 175 - protein, 7 aa, Human severe acute respiratory syndrome virus
HSLMLAS

SEQ ID NO: 176 - protein, 6 aa, Human severe acute respiratory syndrome virus
SNMANA

SEQ ID NO: 177 - protein, 27 aa, Human severe acute respiratory syndrome virus
VILMLEISFVRRSSMDLQCCHLCSLMI

SEQ ID NO: 178 - protein, 7 aa, Human severe acute respiratory syndrome virus
LLPTLLL

SEQ ID NO: 179 - protein, 81 aa, Human severe acute respiratory syndrome virus
LVVLPLLDGHLVLALLFKYLLLCKWHIGSMALELPKMFSMRTKNKSPTNLTRRLVKFKNHLQQHQLHWASCKTLLTRMLKH

SEQ ID NO: 180 - protein, 17 aa, Human severe acute respiratory syndrome virus
THLLNNLALILVQFQVC

SEQ ID NO: 181 - protein, 18 aa, Human severe acute respiratory syndrome virus
MISFRDLIKSRRRYKLTG

SEQ ID NO: 182 - protein, 11 aa, Human severe acute respiratory syndrome virus
LQADFKAFKPM

SEQ ID NO: 183 - protein, 101 aa, Human severe acute respiratory syndrome virus
SGLLKSGLLLILLLLKCLSVFLDNQKELTFVERATTLCPSHKQPRMVLSSYMSRMCHPRRGTSPQRQQFVMKAKHTSLVKVFLCLMALLGLLHRGTSFLHK

SEQ ID NO: 184 - protein, 78 aa, Human severe acute respiratory syndrome virus
LLQTIHLSQEIVMSLLASLTTQFMILCNLSLTHSKKSWTSTSKIIHHQMLILATFQALTLLSSTFKKKLTASMRSLKI

SEQ ID NO: 185 - protein, 30 aa, Human severe acute respiratory syndrome virus
MNHSLTFKNWENMSNILNGLGMFGSASLLD

SEQ ID NO: 186 - protein, 12 aa, Human severe acute respiratory syndrome virus
LPSSWLQSCFVA

SEQ ID NO: 187 - protein, 59 aa, Human severe acute respiratory syndrome virus
LVVAVASRVHALVVLAASLMRMTLSQFSRVSNYITHKRTYGFVYEIFYSWINYCTASKN

SEQ ID NO: 188 - protein, 45 aa, Human severe acute respiratory syndrome virus
QCFSCKYCSCYSNDTATSLTPFRMACYWRCISCCFSERYQNNCAQ

SEQ ID NO: 189 - protein, 7 aa, Human severe acute respiratory syndrome virus
KMAASPL

SEQ ID NO: 190 - protein, 46 aa, Human severe acute respiratory syndrome virus
GLPVHLQFTAAICYHLFTSFACRCRYGGAIFVPLCLDIFSTMHQRM

SEQ ID NO: 191 - protein, 19 aa, Human severe acute respiratory syndrome virus
NYYEMLALLEVQIQEPITL

SEQ ID NO: 192 - protein, 10 aa, Human severe acute respiratory syndrome virus
CQLLCLLAHT

SEQ ID NO: 193 - protein, 5 aa, Human severe acute respiratory syndrome virus
LLYTI

SEQ ID NO: 194 - protein, 9 aa, Human severe acute respiratory syndrome virus
QCHRYNCRY

SEQ ID NO: 195 - protein, 17 aa, Human severe acute respiratory syndrome virus
RHFNTKTQRRLPNWWLF

SEQ ID NO: 196 - protein, 4 aa, Human severe acute respiratory syndrome virus
ALRC

SEQ ID NO: 197 - protein, 16 aa, Human severe acute respiratory syndrome virus
RLCRCTWLFHRSLLPA

SEQ ID NO: 198 - protein, 10 aa, Human severe acute respiratory syndrome virus
VYTNYYRHWY

SEQ ID NO: 199 - protein, 7 aa, Human severe acute respiratory syndrome virus
KCYILHL

SEQ ID NO: 200 - protein, 17 aa, Human severe acute respiratory syndrome virus
RPTECANTHNRRLFRSC

SEQ ID NO: 201 - protein, 7 aa, Human severe acute respiratory syndrome virus
SSNGSNL

SEQ ID NO: 202 - protein, 5 aa, Human severe acute respiratory syndrome virus
ADDDY

SEQ ID NO: 203 - protein, 8 aa, Human severe acute respiratory syndrome virus
RAFVSTRK

SEQ ID NO: 204 - protein, 17 aa, Human severe acute respiratory syndrome virus
VRTYVLIRFGRNRYVNS

SEQ ID NO: 205 - protein, 31 aa, Human severe acute respiratory syndrome virus
RTSFSCFRGILASHTSHPYCASIVCVLLQYC

SEQ ID NO: 206 - protein, 14 aa, Human severe acute respiratory syndrome virus
REFSKTNGLRLLAC

SEQ ID NO: 207 - protein, 5 aa, Human severe acute respiratory syndrome virus
KSELF

SEQ ID NO: 208 - protein, 242 aa, Human severe acute respiratory syndrome virus
SSGLNELTIIIILFGTLTLLIMADNGTITVEELKQLLEQWNLVIGFLFLAWIMLLQFAYSNRNRFLYIIKLVFLWLLWPVTLACFVLAAVYRINWVTGGIAIAMACIVGLMWLSYFVASFRLFARTRSMWSFNPETNILLNVPLRGTIVTRPLMESELVIGAVIIRGHLRMAGHSLGRCDIKDLPKEITVATSRTLSYYKLGASQRVGTDSGFAAYNRYRIGNYKLNTDHAGSNDNIALLVQ

SEQ ID NO: 209 - protein, 8 aa, Human severe acute respiratory syndrome virus
VTTDVSSC

SEQ ID NO: 210 - protein, 23 aa, Human severe acute respiratory syndrome virus
LPGYNSRDIDYHYEDFQDCYLES

SEQ ID NO: 211 - protein, 11 aa, Human severe acute respiratory syndrome virus
RYNKFNSETII

SEQ ID NO: 212 - protein, 7 aa, Human severe acute respiratory syndrome virus
EELFGVR

SEQ ID NO: 213 - protein, 12 aa, Human severe acute respiratory syndrome virus
RTYGVRLSIKRT

SEQ ID NO: 214 - protein, 5 aa, Human severe acute respiratory syndrome virus
KLFSS

SEQ ID NO: 215 - protein, 21 aa, Human severe acute respiratory syndrome virus
LYLHLASYITIRSVLEVRLYY

SEQ ID NO: 216 - protein, 24 aa, Human severe acute respiratory syndrome virus
KNLAHQEHTRAIHHFTLLLTINLH

SEQ ID NO: 217 - protein, 51 aa, Human severe acute respiratory syndrome virus
LALAHTLLLLVLTVLDIPISCVQDQFHQNFSSDKRRFNKSSTRHFFSLLLL

SEQ ID NO: 218 - protein, 12 aa, Human severe acute respiratory syndrome virus
YFASPLRERQNE

SEQ ID NO: 219 - protein, 4 aa, Human severe acute respiratory syndrome virus
AHFN

SEQ ID NO: 220 - protein, 64 aa, Human severe acute respiratory syndrome virus
LLFVLFSLSAIPCFNNAYYILVFTRNPGSRRTLYQSLNEHETSHCFDLYFSMQLHTHCSTALCI

SEQ ID NO: 221 - protein, 4 aa, Human severe acute respiratory syndrome virus
TSCA

SEQ ID NO: 222 - protein, 16 aa, Human severe acute respiratory syndrome virus
GTTLGVILIALLGFVL

SEQ ID NO: 223 - protein, 32 aa, Human severe acute respiratory syndrome virus
ERFYLFIDGTLWFKHAHLMLLSTVKIQLVVRL

SEQ ID NO: 224 - protein, 21 aa, Human severe acute respiratory syndrome virus
LGVGTFMKVTKLLHLETYLLF

SEQ ID NO: 225 - protein, 428 aa, Human severe acute respiratory syndrome virus
INEQIKMSDNGPQSNQRSAPRITFGGPTDSTDNNQNGGRNGARPKQRRPQGLPNNTASWFTALTQHGKEELRFPRGQGVPINTNSGPDDQIGYYRRATRRVRGGDGKMKELSPRWYFYYLGTGPEASLPYGANKEGIVWVATEGALNTPKDHIGTRNPNNNAATVLQLPQGTTLPKGFYAEGSRGGSQASSRSSSRSRGNSRNSTPGSSRGNSPARMASGGGETALALLLLDRLNQLESKVSGKGQQQQGQTVTKKSAAEASKKPRQKRTATKQYNVTQAFGRRGPEQTQGNFGDQDLIRQGTDYKHWPQIAQFAPSASAFFGMSRIGMEVTPSGTWLTYHGAIKLDDKDPQFKDNVILLNKHIDAYKTFPPTEPKKDKKKKTDEAQPLPQRQKKQPTVTLLPAADMDDFSRQLQNSMSGASADSTQA

SEQ ID NO: 226 - protein, 12 aa, Human severe acute respiratory syndrome virus
TLMMTTQGRWAM

SEQ ID NO: 227 - protein, 16 aa, Human severe acute respiratory syndrome virus
TFSQFRLRYIVYSCAE

SEQ ID NO: 228 - protein, 8 aa, Human severe acute respiratory syndrome virus
ILVTKQHK

SEQ ID NO: 229 - protein, 9 aa, Human severe acute respiratory syndrome virus
LTLISHSNL

SEQ ID NO: 230 - protein, 28 aa, Human severe acute respiratory syndrome virus
SMCNIREDLKEPPHFHRGHAEYDRGYSE

SEQ ID NO: 231 - protein, 11 aa, Human severe acute respiratory syndrome virus
GELPIWKSPNV

SEQ ID NO: 232 - protein, 10 aa, Human severe acute respiratory syndrome virus
CYPHVILIAS

SEQ ID NO: 233 - protein, 11 aa, Human severe acute respiratory syndrome virus
ENDKKKKKKKK

SEQ ID NO: 234 - DNA, 29736 bp, Human severe acute respiratory syndrome virus; identical to SEQ ID NO: 4
  CDS (2)..(29734)

SEQ ID NO: 235 - protein, 23 aa, Human severe acute respiratory syndrome virus
YPGKANQPRSLVDLFSKRTLKSV

SEQ ID NO: 236 - protein, 15 aa, Human severe acute respiratory syndrome virus
LSLGCMPSAPTQYKQ

SEQ ID NO: 237 - protein, 9 aa, Human severe acute respiratory syndrome virus
ILLSLTRNE

SEQ ID NO: 238 - protein, 21 aa, Human severe acute respiratory syndrome virus
LVPLLQTAYGFVRVAVDHQHT

SEQ ID NO: 239 - protein, 36 aa, Human severe acute respiratory syndrome virus
VSSGCDRKVRWRALFLVSTRKHTSNSVCLSFRLETC

SEQ ID NO: 240 - protein, 25 aa, Human severe acute respiratory syndrome virus
CVASGTLWKRPYRRHVNTSKMALVV

SEQ ID NO: 241 - protein, 22 aa, Human severe acute respiratory syndrome virus
SWKKAYCPSLNSPMCSLNVLMP

SEQ ID NO: 242 - protein, 24 aa, Human severe acute respiratory syndrome virus
APITATRSLSWLQKWTAFSTVVAV

SEQ ID NO: 243 - protein, 37 aa, Human severe acute respiratory syndrome virus
HWEYSCHMWAKPQLHTAMFFFVRTVIREPVVIAMASI

SEQ ID NO: 244 - protein, 4 aa, Human severe acute respiratory syndrome virus
SLMT

SEQ ID NO: 245 - protein, 174 aa, Human severe acute respiratory syndrome virus
VTSLALIPLKIMNKTGTLSMAVVHSVNSLVSSMEVQSLAMSTTISVAQMGTLLIASKIFSHARASQCALFPNNLITSSRREVSTAAVTMSMKLPGSLSALIRATSTRHPSKLRVPRNLTLSKGNAQSLCFLLTQKSKSFNHVLKRKRLRVSWGVYALCTLLHLHRSVTICTCLP

SEQ ID NO: 246 - protein, 15 aa, Human severe acute respiratory syndrome virus
NVIIAMKFHGRRATF

SEQ ID NO: 247 - protein, 11 aa, Human severe acute respiratory syndrome virus
KPLVNIVALKI

SEQ ID NO: 248 - protein, 15 aa, Human severe acute respiratory syndrome virus
LLKDLLHVGTYLLML

SEQ ID NO: 249 - protein, 79 aa, Human severe acute respiratory syndrome virus
KCHVLPVKTQRLDLSIVLQIITTTQTLKLDSAREVGLDVLEAVCLPMLAAIISVPTGFLVLVLILAQAILALLVTMWRP

SEQ ID NO: 250 - protein, 7 aa, Human severe acute respiratory syndrome virus
MRISLRY

SEQ ID NO: 251 - protein, 14 aa, Human severe acute respiratory syndrome virus
VVNVLTLTLLAIFI

SEQ ID NO: 252 - protein, 21 aa, Human severe acute respiratory syndrome virus
MKRLPSFWHLSLLLQVPLLTL

SEQ ID NO: 253 - protein, 25 aa, Human severe acute respiratory syndrome virus
RVLITSLSKPLLSPAVTIKLPRESP

SEQ ID NO: 254 - protein, 12 aa, Human severe acute respiratory syndrome virus
KVLGTLDNRDQF

SEQ ID NO: 255 - protein, 70 aa, Human severe acute respiratory syndrome virus
HHCVVFPHRLLVLSDQFLRAHLMQQTTQFLICKEQLSPYLMVFLNSHYVLSTPWFILQTCSPTVSLLWHM

SEQ ID NO: 256 - protein, 73 aa, Human severe acute respiratory syndrome virus
LVVLYNRLLSGCLIFWALLLKNSGLSLNGLRRNLVQELNFSRMLGRFSNFSLQVFLTSSRVKYRLLQITSRIV

SEQ ID NO: 257 - protein, 29 aa, Human severe acute respiratory syndrome virus
NASLMLLTRHSKCALIKSLSLAQSCDHST

SEQ ID NO: 258 - protein, 33 aa, Human severe acute respiratory syndrome virus
VKSSSLKARDFTVSVYVARSSCNYSCLLRHQKK

SEQ ID NO: 259 - protein, 45 aa, Human severe acute respiratory syndrome virus
PFLKVIHMTQYLPLRRLFSRTVNSKHSRRPLIASQMELSLAHQSV

SEQ ID NO: 260 - protein, 5 aa, Human severe acute respiratory syndrome virus
MASCS

SEQ ID NO: 261 - protein, 23 aa, Human severe acute respiratory syndrome virus
RLRTKNNTAHCLLVYWLQTMSFA

SEQ ID NO: 262 - protein, 8 aa, Human severe acute respiratory syndrome virus
KGVHQLKV

SEQ ID NO: 263 - protein, 15 aa, Human severe acute respiratory syndrome virus
PLEKILFGKFKVTRM

SEQ ID NO: 264 - protein, 35 aa, Human severe acute respiratory syndrome virus
ESHLSLMNVLTKCLMKSALSTLLNPVPKLLSLHVL

SEQ ID NO: 265 - protein, 4 aa, Human severe acute respiratory syndrome virus
QRLL

SEQ ID NO: 266 - protein, 21 aa, Human severe acute respiratory syndrome virus
RLYNQFLISLPTWVLILMSGV

SEQ ID NO: 267 - protein, 106 aa, Human severe acute respiratory syndrome virus
LHSTYLMMLVKKTFHHVCIVPFTLQMRKKRTMQSVRKKKLMKPVNMSTVQRMIIKVSLWNLVPQLKQFELRKKKRKTGWMILLSNQRLSQNQNLHLKNQLISLLVI

SEQ ID NO: 268 - protein, 23 aa, Human severe acute respiratory syndrome virus
NLLTMLPLNVLTSLRRHKVLILW

SEQ ID NO: 269 - protein, 6 aa, Human severe acute respiratory syndrome virus
MLLTYT

SEQ ID NO: 270 - protein, 5 aa, Human severe acute respiratory syndrome virus
NMVVV

SEQ ID NO: 271 - protein, 21 aa, Human severe acute respiratory syndrome virus
QVHSTRQPMVPCKRRVMITLS

SEQ ID NO: 272 - protein, 5 aa, Human severe acute respiratory syndrome virus
MALLQ

SEQ ID NO: 273 - protein, 22 aa, Human severe acute respiratory syndrome virus
EGLVCFLDIILLRSVCMLLDLT

SEQ ID NO: 274 - protein, 71 aa, Human severe acute respiratory syndrome virus
MQVRTSSFLRQHMKISIHRTSYLHHCCQQAYLVLNHFSLYKCACRRFVHRFILQSMTKLFMSRLSWIILIT

SEQ ID NO: 275 - protein, 31 aa, Human severe acute respiratory syndrome virus
SLEWKHLNKRSHQTQKIPKLRRNLSYRSLSM

SEQ ID NO: 276 - protein, 58 aa, Human severe acute respiratory syndrome virus
SQKLRPALMRLPQHWKKLSFLPISYSCLLISMVSFTMILRTCLEVKICLSLRRMHLTW

SEQ ID NO: 277 - protein, 12 aa, Human severe acute respiratory syndrome virus
VMLSLVVISLVL

SEQ ID NO: 278 - protein, 16 aa, Human severe acute respiratory syndrome virus
YPPKRLVALLRCSQEL

SEQ ID NO: 279 - protein, 8 aa, Human severe acute respiratory syndrome virus
RKCQLMSI

SEQ ID NO: 280 - protein, 41 aa, Human severe acute respiratory syndrome virus
PRTLDKDVLVIHLRKLRLLLRNANLHFMYYLQKHLMLRKRF

SEQ ID NO: 281 - protein, 6 aa, Human severe acute respiratory syndrome virus
ELYPGI

SEQ ID NO: 282 - protein, 12 aa, Human severe acute respiratory syndrome virus
EKCLLMLKRQEN

SEQ ID NO: 283 - protein, 9 aa, Human severe acute respiratory syndrome virus
CLYAWMLEP

SEQ ID NO: 284 - protein, 32 aa, Human severe acute respiratory syndrome virus
WQPSNVSIKELKFKRASLTMVSDSSFILVKSL

SEQ ID NO: 285 - protein, 6 aa, Human severe acute respiratory syndrome virus
LLLLRS

SEQ ID NO: 286 - protein, 11 aa, Human severe acute respiratory syndrome virus
MSRLSQCQLVM

SEQ ID NO: 287 - protein, 20 aa, Human severe acute respiratory syndrome virus
HMVLILKRLRAVCVLLKLLP

SEQ ID NO: 288 - protein, 27 aa, Human severe acute respiratory syndrome virus
CQYHHQMLLLHIMDTSLRHQRHLRSTL

SEQ ID NO: 289 - protein, 20 aa, Human severe acute respiratory syndrome virus
KQFLWLALTEIGPIQDSVQS

SEQ ID NO: 290 - protein, 33 aa, Human severe acute respiratory syndrome virus
VLNFLSVVTKLCTTLWRAPSSFILTVRFFHLTN

SEQ ID NO: 291 - protein, 11 aa, Human severe acute respiratory syndrome virus
RVSYPCGRLRL

SEQ ID NO: 292 - protein, 19 aa, Human severe acute respiratory syndrome virus
KCSQLWTTLISTHSLWICL

SEQ ID NO: 293 - protein, 22 aa, Human severe acute respiratory syndrome virus
HMDSSLVQHTWMVLMLQKLNLM

SEQ ID NO: 294 - protein, 38 aa, Human severe acute respiratory syndrome virus
IMRVRLSLYYLVMTHYVVKLSSTTILLMRVFLVGTCLL

SEQ ID NO: 295 - protein, 13 aa, Human severe acute respiratory syndrome virus
TTQRNGNFLKLVV

SEQ ID NO: 296 - protein, 16 aa, Human severe acute respiratory syndrome virus
LQLNGLITIVICLVFY

SEQ ID NO: 297 - protein, 50 aa, Human severe acute respiratory syndrome virus
HFNSLKSNSMHQHFKRLIIEPVLVMLLTFVHSYSLTVIKLLASLVMSEKL

SEQ ID NO: 298 - protein, 29 aa, Human severe acute respiratory syndrome virus
PIFYSMLIWNLQSEFLMWCVNIVVRKLLP

SEQ ID NO: 299 - protein, 28 aa, Human severe acute respiratory syndrome virus
CIWVLYLMIILRQVFPFHVCVVVMLHNI

SEQ ID NO: 300 - protein, 8 aa, Human severe acute respiratory syndrome virus
YNKSLLLL

SEQ ID NO: 301 - protein, 32 aa, Human severe acute respiratory syndrome virus
CLHHLLSINYSKVHSYVRMSTLVTISVVITLI

SEQ ID NO: 302 - protein, 23 aa, Human severe acute respiratory syndrome virus
LLRRPSIVLTELTLQRCQSTKDQ

SEQ ID NO: 303 - protein, 48 aa, Human severe acute respiratory syndrome virus
LMFSTRKHLTLQPSSLCRINSMELLTQRLNQNWMGIIKRIMLTIQSSL

SEQ ID NO: 304 - protein, 28 aa, Human severe acute respiratory syndrome virus
TLYQLNHYQMRVLIISNSHVLTQNLLMI

SEQ ID NO: 305 - protein, 18 aa, Human severe acute respiratory syndrome virus
QASQSQLHESYLSHSSQT

SEQ ID NO: 306 - protein, 51 aa, Human severe acute respiratory syndrome virus
WLLTIDTIQRVSRKVLNYCISQLFGTLTRLQPRQRSNQTLGVYVVFGVQSQ

SEQ ID NO: 307 - protein, 10 aa, Human severe acute respiratory syndrome virus
ILQIHLKFWQ

SEQ ID NO: 308 - protein, 20 aa, Human severe acute respiratory syndrome virus
KTHKEWTILLVKVNNPPLKK

SEQ ID NO: 309 - protein, 10 aa, Human severe acute respiratory syndrome virus
WKILPYRRKS

SEQ ID NO: 310 - protein, 5 aa, Human severe acute respiratory syndrome virus
KLPKL

SEQ ID NO: 311 - protein, 13 aa, Human severe acute respiratory syndrome virus
AMSYLNHQMKVLK

SEQ ID NO: 312 - protein, 24 aa, Human severe acute respiratory syndrome virus
VMRILWLLMWKTQALPLRNLMSFH

SEQ ID NO: 313 - protein, 26 aa, Human severe acute respiratory syndrome virus
KQLPLMVLLQLIVFLGVKFWLMSNHS

SEQ ID NO: 314 - protein, 13 aa, Human severe acute respiratory syndrome virus
DKQQLQHQIALRD

SEQ ID NO: 315 - protein, 57 aa, Human severe acute respiratory syndrome virus
HNVCLTIICLMCLHYCSNCVLLLKVPILELELHYLQLLLKIVLRVLLNYVWMPALIM

SEQ ID NO: 316 - protein, 17 aa, Human severe acute respiratory syndrome virus
SHPNFLNCSQSLCGYCC

SEQ ID NO: 317 - protein, 45 aa, Human severe acute respiratory syndrome virus
LLLLVYSYLILVLLLIVMALENCILIRLTLLLWISVKVLFLAAFV

SEQ ID NO: 318 - protein, 13 aa, Human severe acute respiratory syndrome virus
TPLILIQLLKPFR

SEQ ID NO: 319 - protein, 6 aa, Human severe acute respiratory syndrome virus
RFHRTS

SEQ ID NO: 320 - protein, 19 aa, Human severe acute respiratory syndrome virus
VWPLSGFWHICCSQNSFIY

SEQ ID NO: 321 - protein, 4 aa, Human severe acute respiratory syndrome virus
VFQL

SEQ ID NO: 322 - protein, 63 aa, Human severe acute respiratory syndrome virus
CRCSLAILLVISSAILGSCGLSLVLYKWHPFLQWLGCTSSLLLSTTYGRAMFISWMVAPLRLA

SEQ ID NO: 323 - protein, 19 aa, Human severe acute respiratory syndrome virus
CAISAIVPHALSVQLLLMA

SEQ ID NO: 324 - protein, 65 aa, Human severe acute respiratory syndrome virus
RDLSMSMQMEAVASARLTIGIVSIVTHFALVVHSLVMKLLVICHSSLKDQSTLLTSHRILLIVLL

SEQ ID NO: 325 - protein, 27 aa, Human severe acute respiratory syndrome virus
KMARFTSTLTRLVKRPMRDILSPILSI

SEQ ID NO: 326 - protein, 13 aa, Human severe acute respiratory syndrome virus
ELTTLKVHCLLMS

SEQ ID NO: 327 - protein, 22 aa, Human severe acute respiratory syndrome virus
FLMASPNATSLLLSLLLCTTVS

SEQ ID NO: 328 - protein, 55 aa, Human severe acute respiratory syndrome virus
CANLFCCLTKLLYQTLEIVLKFPLRCLMLMSTPFQQLLVFLWKNLRHLLLQLTAS

SEQ ID NO: 329 - protein, 36 aa, Human severe acute respiratory syndrome virus
MVSFLHSCQLPDKVLLIPMLTQRMLLNVSNFHITLT

SEQ ID NO: 330 - protein, 17 aa, Human severe acute respiratory syndrome virus
QVTVVTISCSPIIRLKT

SEQ ID NO: 331 - protein, 19 aa, Human severe acute respiratory syndrome virus
RPEILAHVLTVMQGISMPK

SEQ ID NO: 332 - protein, 11 aa, Human severe acute respiratory syndrome virus
QKVTMFHSSGM

SEQ ID NO: 333 - protein, 26 aa, Human severe acute respiratory syndrome virus
KTTCLYLNSCVNKFVVLPRRTTYLLD

SEQ ID NO: 334 - protein, 11 aa, Human severe acute respiratory syndrome virus
LVLQLDRLSMS

SEQ ID NO: 335 - protein, 98 aa, Human severe acute respiratory syndrome virus
LLKSHSRVVRLLVLVLNLCLRPHYCAFLLHWFVISLCQYIHCQSMMVTQMKSLVTKPFRMVSLVTSFLLMIVLQINMLVLTHGLASVVVHTKMTKAAL

SEQ ID NO: 336 - protein, 10 aa, Human severe acute respiratory syndrome virus
LLSLQERLVS

SEQ ID NO: 337 - protein, 8 aa, Human severe acute respiratory syndrome virus
CLAYRVLC

SEQ ID NO: 338 - protein, 64 aa, Human severe acute respiratory syndrome virus
EQSMVTSCIFYLVFLVLLATFATHLPNSLSIVILLPLLAFLLLSVQFLRMLWANLCHIVMTLIC

SEQ ID NO: 339 - protein, 35 aa, Human severe acute respiratory syndrome virus
RVLFLIVSFVQTLVMCLWMVPSYSFLTLTWRVLLE

SEQ ID NO: 340 - protein, 17 aa, Human severe acute respiratory syndrome virus
QLLMLSTVDMVHAKGQK

SEQ ID NO: 341 - protein, 29 aa, Human severe acute respiratory syndrome virus
VFAYLPVVDGFLIMSITELYQEFSVVLMR

SEQ ID NO: 342 - protein, 13 aa, Human severe acute respiratory syndrome virus
LTSLLLLCNLWVL

SEQ ID NO: 343 - protein, 5 aa, Human severe acute respiratory syndrome virus
MCLLQ

SEQ ID NO: 344 - protein, 9 aa, Human severe acute respiratory syndrome virus
WLVVLLPYW

SEQ ID NO: 345 - protein, 7 aa, Human severe acute respiratory syndrome virus
LVLPTTL

SEQ ID NO: 346 - protein, 20 aa, Human severe acute respiratory syndrome virus
NSDVLLVSTTMLLLLMHFCF

SEQ ID NO: 347 - protein, 25 aa, Human severe acute respiratory syndrome virus
CLSLYSVWHQLTAFCRESTQSFTCT

SEQ ID NO: 348 - protein, 27 aa, Human severe acute respiratory syndrome virus
HSISPMMFHSWLTFNGLPCFLLLCLFG

SEQ ID NO: 349 - protein, 9 aa, Human severe acute respiratory syndrome virus
QQSMYSVFL

SEQ ID NO: 350 - protein, 40 aa, Human severe acute respiratory syndrome virus
STAIGSLTTILGKESCLMELHLVPSRRLLCVPFCSTRKCT

SEQ ID NO: 351 - protein, 29 aa, Human severe acute respiratory syndrome virus
NCVARHCCHLHSITGILLYITSTSISVEP

SEQ ID NO: 352 - protein, 12 aa, Human severe acute respiratory syndrome virus
ILPAIVKQLAAT

SEQ ID NO: 353 - protein, 44 aa, Human severe acute respiratory syndrome virus
MTLATQVLMFSTNHHRHQSLLLFCRVVLGKWHSRQAKLKGAWYK

SEQ ID NO: 354 - protein, 94 aa, Human severe acute respiratory syndrome virus
PVELQLLMDCGWMTQYTVQDMSFAQQKTCLILTMKICSFANPTIAFLFRLAMFNFVLLAILCKIVCLGLKLILLTLRHPSINLSVSNLVKHFQF

SEQ ID NO: 355 - protein, 14 aa, Human severe acute respiratory syndrome virus
HATMVHHLVFISVP

SEQ ID NO: 356 - protein, 46 aa, Human severe acute respiratory syndrome virus
DLIIPLKVLSLMDHVVVLVLTLIMIACLSAICIIWSFQQEYTLVLT

SEQ ID NO: 357 - protein, 22 aa, Human severe acute respiratory syndrome virus
KVNSMVHLLTDKLHRLQVQTQP

SEQ ID NO: 358 - protein, 24 aa, Human severe acute respiratory syndrome virus
MFWHGCMLLLSMVIGGFLIDSPLL

SEQ ID NO: 359 - protein, 7 aa, Human severe acute respiratory syndrome virus
MTLTLWQ

SEQ ID NO: 360 - protein, 6 aa, Human severe acute respiratory syndrome virus
STTMNL

SEQ ID NO: 361 - protein, 19 aa, Human severe acute respiratory syndrome virus
HKIMLTYWDLFLLKQELPS

SEQ ID NO: 362 - protein, 5 aa, Human severe acute respiratory syndrome virus
ICVLL

SEQ ID NO: 363 - protein, 7 aa, Human severe acute respiratory syndrome virus
KSCCRMV

SEQ ID NO: 364 - protein, 10 aa, Human severe acute respiratory syndrome virus
MVVLSLVALF

SEQ ID NO: 365 - protein, 34 aa, Human severe acute respiratory syndrome virus
KMSLHHLMLLDNALVLPSKVSSRKLLRALIIGCF

SEQ ID NO: 366 - protein, 67 aa, Human severe acute respiratory syndrome virus
FLFKVHSGHCFSLFTRMLSCHLLLVLWQLLHVLCCLLSISTHSCACFCYLLLQQLLTLIWSTCLLAG

SEQ ID NO: 367 - protein, 24 aa, Human severe acute respiratory syndrome virus
HGLNWLTLACLVIGLRIVLCMLQL

SEQ ID NO: 368 - protein, 5 aa, Human severe acute respiratory syndrome virus
FCLFS

SEQ ID NO: 369 - protein, 15 aa, Human severe acute respiratory syndrome virus
QLALFMMMLLDVFGH

SEQ ID NO: 370 - protein, 14 aa, Human severe acute respiratory syndrome virus
MSLHLFTKSTMVML

SEQ ID NO: 371 - protein, 8 aa, Human severe acute respiratory syndrome virus
IKLFPCGP

SEQ ID NO: 372 - protein, 13 aa, Human severe acute respiratory syndrome virus
PLTILVSLRLSCF

SEQ ID NO: 373 - protein, 27 aa, Human severe acute respiratory syndrome virus
CLCVLSITHCYLLLATPYSVSCLFIVS

SEQ ID NO: 374 - protein, 36 aa, Human severe acute respiratory syndrome virus
AIVAAATLAFSVYSTVTSGLLLVFMTTWSLHKNLGI

SEQ ID NO: 375 - protein, 41 aa, Human severe acute respiratory syndrome virus
TPRGFCLLRVVLMLSSLTLSCWVLEVNHVSRLLLYSLKCLT

SEQ ID NO: 376 - protein, 15 aa, Human severe acute respiratory syndrome virus
SAHLWYCSRFFNNLE

SEQ ID NO: 377 - protein, 43 aa, Human severe acute respiratory syndrome virus
SHLLNCGHNVYNSTMIFFLQKTQLKLSRRWFLFCLFCYPCRVL

SEQ ID NO: 378 - protein, 42 aa, Human severe acute respiratory syndrome virus
TLIGCARKCSITVLLFRLLLQNLVLYHHMPLMPLPRRPMSRL

SEQ ID NO: 379 - protein, 11 aa, Human severe acute respiratory syndrome virus
LMVILKSFSKS

SEQ ID NO: 380 - protein, 24 aa, Human severe acute respiratory syndrome virus
MWLNLSLTVMLPCNASWKRWQIRL

SEQ ID NO: 381 - protein, 15 aa, Human severe acute respiratory syndrome virus
PKCTNRQDLRTRGQK

SEQ ID NO: 382 - protein, 38 aa, Human severe acute respiratory syndrome virus
LVLCKQCSSLCLGSLIMMHLTTLSTMRVMVVFHSTSYH

SEQ ID NO: 383 - protein, 66 aa, Human severe acute respiratory syndrome virus
LQQPNSWLLSLIMVPTRTLVMVTPLHMHLHSGKSSKLLMRIARLFNLVKLTWTIHQIWLGLLLLQL

SEQ ID NO: 384 - protein, 12 aa, Human severe acute respiratory syndrome virus
EPTQLLNYRIMN

SEQ ID NO: 385 - protein, 77 aa, Human severe acute respiratory syndrome virus
HYDRCPVRLVPHKQLVLMTMHLPTITIRREVGLCWHYYQTTKISNGLDSLRVMVQVQFTQNWNHLVGLLQTHQKGLK

SEQ ID NO: 386 - protein, 8 aa, Human severe acute respiratory syndrome virus
NTCTSSKA

SEQ ID NO: 387 - protein, 8 aa, Human severe acute respiratory syndrome virus
IEVWCWAV

SEQ ID NO: 388 - protein, 27 aa, Human severe acute respiratory syndrome virus
LLQYVFRLEMLQKYLPIQLCFPSVLLQ

SEQ ID NO: 389 - protein, 9 aa, Human severe acute respiratory syndrome virus
TLLKHIRIT

SEQ ID NO: 390 - protein, 10 aa, Human severe acute respiratory syndrome virus
QVEDNQSPTV

SEQ ID NO: 391 - protein, 14 aa, Human severe acute respiratory syndrome virus
RCCVHTLVQDRQLL

SEQ ID NO: 392 - protein, 34 aa, Human severe acute respiratory syndrome virus
HQKLTWTKSPLVVLHVVCIVDATLTIQILKDSVT

SEQ ID NO: 393 - protein, 44 aa, Human severe acute respiratory syndrome virus
KVSTSKYLPLVLMTQWVLHLETQSVPSAECGKVMAVVVTNSANP

SEQ ID NO: 394 - protein, 9 aa, Human severe acute respiratory syndrome virus
CSLRMHQRF

SEQ ID NO: 395 - protein, 17 aa, Human severe acute respiratory syndrome virus
TGLRCKCSPSYTVRHRH

SEQ ID NO: 396 - protein, 6 aa, Human severe acute respiratory syndrome virus
CRLQGF

SEQ ID NO: 397 - protein, 15 aa, Human severe acute respiratory syndrome virus
YLQRKSCWFCKVPKN

SEQ ID NO: 398 - protein, 8 aa, Human severe acute respiratory syndrome virus
LLSLPGEG

SEQ ID NO: 399 - protein, 11 aa, Human severe acute respiratory syndrome virus
GRQFIRLLLCS

SEQ ID NO: 400 - protein, 5 aa, Human severe acute respiratory syndrome virus
EAYYV

SEQ ID NO: 401 - protein, 4 aa, Human severe acute respiratory syndrome virus
RDYL

SEQ ID NO: 402 - protein, 8 aa, Human severe acute respiratory syndrome virus
RLSSGCCP

SEQ ID NO: 403 - protein, 4 aa, Human severe acute respiratory syndrome virus
LFQV

SEQ ID NO: 404 - protein, 11 aa, Human severe acute respiratory syndrome virus
HGTTYITSASN

SEQ ID NO: 405 - protein, 4 aa, Human severe acute respiratory syndrome virus
IHNG

SEQ ID NO: 406 - protein, 8 aa, Human severe acute respiratory syndrome virus
FSLCSTSF

SEQ ID NO: 407 - protein, 12 aa, Human severe acute respiratory syndrome virus
YIKRNTRHIQLL

SEQ ID NO: 408 - protein, 4 aa, Human severe acute respiratory syndrome virus
EGLV

SEQ ID NO: 409 - protein, 5 aa, Human severe acute respiratory syndrome virus
LRRES

SEQ ID NO: 410 - protein, 6 aa, Human severe acute respiratory syndrome virus
HLTRIC

SEQ ID NO: 411 - protein, 17 aa, Human severe acute respiratory syndrome virus
ACTPIIIKDCTILRCYA

SEQ ID NO: 412 - protein, 10 aa, Human severe acute respiratory syndrome virus
CRHCRRTDIR

SEQ ID NO: 413 - protein, 7 aa, Human severe acute respiratory syndrome virus
WELVRFR

SEQ ID NO: 414 - protein, 27 aa, Human severe acute respiratory syndrome virus
FRTSSTRLRSSYCGFILLIADAHPHFD

SEQ ID NO: 415 - protein, 4 aa, Human severe acute respiratory syndrome virus
GIGC

SEQ ID NO: 416 - protein, 5 aa, Human severe acute respiratory syndrome virus
VPYGC

SEQ ID NO: 417 - protein, 6 aa, Human severe acute respiratory syndrome virus
SRKTTY

SEQ ID NO: 418 - protein, 6 aa, Human severe acute respiratory syndrome virus
VGFAEI

SEQ ID NO: 419 - protein, 13 aa, Human severe acute respiratory syndrome virus
FYGRETLSLRPLF

SEQ ID NO: 420 - protein, 11 aa, Human severe acute respiratory syndrome virus
ILGPDIPSQLY

SEQ ID NO: 421 - protein, 8 aa, Human severe acute respiratory syndrome virus
VYPSLCKL

SEQ ID NO: 422 - protein, 35 aa, Human severe acute respiratory syndrome virus
CVIFYCVSTYKFWTTSKKNICRWCSFCCFNWIPFS

SEQ ID NO: 423 - protein, 5 aa, Human severe acute respiratory syndrome virus
VRSRT

SEQ ID NO: 424 - protein, 6 aa, Human severe acute respiratory syndrome virus
SGCKLT

SEQ ID NO: 425 - protein, 13 aa, Human severe acute respiratory syndrome virus
LASQFQGTFSVCC

SEQ ID NO: 426 - protein, 13 aa, Human severe acute respiratory syndrome virus
SSYACSFWQFIAR

SEQ ID NO: 427 - protein, 22 aa, Human severe acute respiratory syndrome virus
THYMLFSSCTNKQCCFSNCQTR

SEQ ID NO: 428 - protein, 4 aa, Human severe acute respiratory syndrome virus
LCCV

SEQ ID NO: 429 - protein, 5 aa, Human severe acute respiratory syndrome virus
GRKFC

SEQ ID NO: 430 - protein, 15 aa, Human severe acute respiratory syndrome virus
TKTLLLCSGWQRCYQ

SEQ ID NO: 431 - protein, 4 aa, Human severe acute respiratory syndrome virus
LLSL

SEQ ID NO: 432 - protein, 5 aa, Human severe acute respiratory syndrome virus
SANNV

SEQ ID NO: 433 - protein, 8 aa, Human severe acute respiratory syndrome virus
YQTTPIRS

SEQ ID NO: 434 - protein, 7 aa, Human severe acute respiratory syndrome virus
LLRWWLY

SEQ ID NO: 435 - protein, 6 aa, Human severe acute respiratory syndrome virus
CQPSNR

SEQ ID NO: 436 - protein, 6 aa, Human severe acute respiratory syndrome virus
ISWFPI

SEQ ID NO: 437 - protein, 4 aa, Human severe acute respiratory syndrome virus
LNEL

SEQ ID NO: 438 - protein, 9 aa, Human severe acute respiratory syndrome virus
GSRCTFRVY

SEQ ID NO: 439 - protein, 10 aa, Human severe acute respiratory syndrome virus
CHPYYNSNES

SEQ ID NO: 440 - protein, 10 aa, Human severe acute respiratory syndrome virus
SSHRSWCLYL

SEQ ID NO: 441 - protein, 4 aa, Human severe acute respiratory syndrome virus
YYDK

SEQ ID NO: 442 - protein, 13 aa, Human severe acute respiratory syndrome virus
TVSSEIIEVNSRH

SEQ ID NO: 443 - protein, 16 aa, Human severe acute respiratory syndrome virus
RSYCGNWNKQVLRWLA

SEQ ID NO: 444 - protein, 7 aa, Human severe acute respiratory syndrome virus
YVKNCLQ

SEQ ID NO: 445 - protein, 14 aa, Human severe acute respiratory syndrome virus
CRNSTPYGLGLSKM

SEQ ID NO: 446 - protein, 4 aa, Human severe acute respiratory syndrome virus
QSHA

SEQ ID NO: 447 - protein, 11 aa, Human severe acute respiratory syndrome virus
DNGLSCSCSQT

SEQ ID NO: 448 - protein, 9 aa, Human severe acute respiratory syndrome virus
LITPFLQVS

SEQ ID NO: 449 - protein, 7 aa, Human severe acute respiratory syndrome virus
RVCASIK

SEQ ID NO: 450 - protein, 10 aa, Human severe acute respiratory syndrome virus
DGHVWRLTIC

SEQ ID NO: 451 - protein, 7 aa, Human severe acute respiratory syndrome virus
TRWNIIR

SEQ ID NO: 452 - protein, 6 aa, Human severe acute respiratory syndrome virus
CYNCLC

SEQ ID NO: 453 - protein, 15 aa, Human severe acute respiratory syndrome virus
HLSSCYSQCKCTSFN

SEQ ID NO: 454 - protein, 11 aa, Human severe acute respiratory syndrome virus
QVCPQSTTQAL

SEQ ID NO: 455 - protein, 6 aa, Human severe acute respiratory syndrome virus
VLRLPA

SEQ ID NO: 456 - protein, 8 aa, Human severe acute respiratory syndrome virus
TFLHDDSF

SEQ ID NO: 457 - protein, 5 aa, Human severe acute respiratory syndrome virus
CRCVL

SEQ ID NO: 458 - protein, 8 aa, Human severe acute respiratory syndrome virus
LCGSRFSS

SEQ ID NO: 459 - protein, 7 aa, Human severe acute respiratory syndrome virus
GSSLLSK

SEQ ID NO: 460 - protein, 4 aa, Human severe acute respiratory syndrome virus
CVHV

SEQ ID NO: 461 - protein, 5 aa, Human severe acute respiratory syndrome virus
GKMLD

SEQ ID NO: 462 - protein, 13 aa, Human severe acute respiratory syndrome virus
RTSRILLTAYNAS

SEQ ID NO: 463 - protein, 20 aa, Human severe acute respiratory syndrome virus
LRVPALPRSIKNIRRRLFCR

SEQ ID NO: 464 - protein, 10 aa, Human severe acute respiratory syndrome virus
YCQNRWYTYD

SEQ ID NO: 465 - protein, 7 aa, Human severe acute respiratory syndrome virus
KVRVTGY

SEQ ID NO: 466 - protein, 8 aa, Human severe acute respiratory syndrome virus
CLPTYKTS

SEQ ID NO: 467 - protein, 4 aa, Human severe acute respiratory syndrome virus
SGVC

SEQ ID NO: 468 - protein, 9 aa, Human severe acute respiratory syndrome virus
CLSLVFTIH

SEQ ID NO: 469 - protein, 14 aa, Human severe acute respiratory syndrome virus
AYWPHVGHVFRNAN

SEQ ID NO: 470 - protein, 7 aa, Human severe acute respiratory syndrome virus
HLTVLGT

SEQ ID NO: 471 - protein, 30 aa, Human severe acute respiratory syndrome virus
GYVHTTYSLAGCRCLCIVQFTDFTSLRCLY

SEQ ID NO: 472 - protein, 10 aa, Human severe acute respiratory syndrome virus
ETIPMLQVLL

SEQ ID NO: 473 - protein, 13 aa, Human severe acute respiratory syndrome virus
PCHFNITQISVVC

SEQ ID NO: 474 - protein, 9 aa, Human severe acute respiratory syndrome virus
SLCLQCPRL

SEQ ID NO: 475 - protein, 16 aa, Human severe acute respiratory syndrome virus
CDTTVSRRYELLLQVT

SEQ ID NO: 476 - protein, 5 aa, Human severe acute respiratory syndrome virus
FSIMC

SEQ ID NO: 477 - protein, 14 aa, Human severe acute respiratory syndrome virus
WSGFWFIQKHMCRQ

SEQ ID NO: 478 - protein, 7 aa, Human severe acute respiratory syndrome virus
LQCDSNM

SEQ ID NO: 479 - protein, 11 aa, Human severe acute respiratory syndrome virus
CWRLHTCQHLY

SEQ ID NO: 480 - protein, 13 aa, Human severe acute respiratory syndrome virus
ETQAFRSRNAQSH

SEQ ID NO: 481 - protein, 13 aa, Human severe acute respiratory syndrome virus
AVIWYCHCTRSTL

SEQ ID NO: 482 - protein, 12 aa, Human severe acute respiratory syndrome virus
QRIASFMGGWKT

SEQ ID NO: 483 - protein, 15 aa, Human severe acute respiratory syndrome virus
TTIEQKLCLYWLPCN

SEQ ID NO: 484 - protein, 8 aa, Human severe acute respiratory syndrome virus
STDWRVHL

SEQ ID NO: 485 - protein, 15 aa, Human severe acute respiratory syndrome virus
CCCVQRYYDIQVECW

SEQ ID NO: 486 - protein, 12 aa, Human severe acute respiratory syndrome virus
LLCVDISHCNAT

SEQ ID NO: 487 - protein, 24 aa, Human severe acute respiratory syndrome virus
CTYSSATRALCENYWLVPNTQHLR

SEQ ID NO: 488 - protein, 23 aa, Human severe acute respiratory syndrome virus
QCCKLSKGRHAKVLYTPRTTWYW

SEQ ID NO: 489 - protein, 26 aa, Human severe acute respiratory syndrome virus
ESFCHRTCSLLPICSHSVYGMLSCSC

SEQ ID NO: 490 - protein, 9 aa, Human severe acute respiratory syndrome virus
KGIKIFAHR

SEQ ID NO: 491 - protein, 11 aa, Human severe acute respiratory syndrome virus
NHTCACARRVF

SEQ ID NO: 492 - protein, 23 aa, Human severe acute respiratory syndrome virus
IQSEFNTRTVCFLHCKCIARNNC

SEQ ID NO: 493 - protein, 4 aa, Human severe acute respiratory syndrome virus
HCSL

SEQ ID NO: 494 - protein, 5 aa, Human severe acute respiratory syndrome virus
NLYGY

SEQ ID NO: 495 - protein, 6 aa, Human severe acute respiratory syndrome virus
LECCQC

SEQ ID NO: 496 - protein, 23 aa, Human severe acute respiratory syndrome virus
TSCKTLRLYWRSCSITSPPHIAD

SEQ ID NO: 497 - protein, 8 aa, Human severe acute respiratory syndrome virus
RHTRTRIF

SEQ ID NO: 498 - protein, 23 aa, Human severe acute respiratory syndrome virus
FSVQTYENNRSRHVPWNLSPLSC

SEQ ID NO: 499 - protein, 7 aa, Human severe acute respiratory syndrome virus
HCECFSL

SEQ ID NO: 500 - protein, 22 aa, Human severe acute respiratory syndrome virus
AKSTQGEVSSMLQNVLQRCYYT

SEQ ID NO: 501 - protein, 32 aa, Human severe acute respiratory syndrome virus
CFICNQQTSNRRCKRISYTQSCLEKSCFYLTL

SEQ ID NO: 502 - protein, 17 aa, Human severe acute respiratory syndrome virus
FTERCSFKNLRIAYADC

SEQ ID NO: 503 - protein, 5 aa, Human severe acute respiratory syndrome virus
FITGF

SEQ ID NO: 504 - protein, 8 aa, Human severe acute respiratory syndrome virus
LCHIHTNY

SEQ ID NO: 505 - protein, 5 aa, Human severe acute respiratory syndrome virus
NSTLL

SEQ ID NO: 506 - protein, 20 aa, Human severe acute respiratory syndrome virus
CQPFQCGYHKGKNWHFVHNV

SEQ ID NO: 507 - protein, 26 aa, Human severe acute respiratory syndrome virus
QTAIYKSRNTTSQCGYITSRKCNWTF

SEQ ID NO: 508 - protein, 16 aa, Human severe acute respiratory syndrome virus
DHYWSSSYTGTYTPQR

SEQ ID NO: 509 - protein, 5 aa, Human severe acute respiratory syndrome virus
YKVQD

SEQ ID NO: 510 - protein, 4 aa, Human severe acute respiratory syndrome virus
RIMC

SEQ ID NO: 511 - protein, 11 aa, Human severe acute respiratory syndrome virus
HTRHTKGHDLP

SEQ ID NO: 512 - protein, 17 aa, Human severe acute respiratory syndrome virus
THLYDGFQNELPSQWLP

SEQ ID NO: 513 - protein, 18 aa, Human severe acute respiratory syndrome virus
YVYHPRRSYSSRSCVDWL

SEQ ID NO: 514 - protein, 7 aa, Human severe acute respiratory syndrome virus
CRGLSCN

SEQ ID NO: 515 - protein, 5 aa, Human severe acute respiratory syndrome virus
RCCGY

SEQ ID NO: 516 - protein, 11 aa, Human severe acute respiratory syndrome virus
PTSPARIFYRC

SEQ ID NO: 517 - protein, 9 aa, Human severe acute respiratory syndrome virus
LSSCTDWLC

SEQ ID NO: 518 - protein, 6 aa, Human severe acute respiratory syndrome virus
HRIHQS

SEQ ID NO: 519 - protein, 6 aa, Human severe acute respiratory syndrome virus
CKTSTR

SEQ ID NO: 520 - protein, 7 aa, Human severe acute respiratory syndrome virus
TSYTTHV

SEQ ID NO: 521 - protein, 9 aa, Human severe acute respiratory syndrome virus
RLALECSAY

SEQ ID NO: 522 - protein, 6 aa, Human severe acute respiratory syndrome virus
DSTNAQ

SEQ ID NO: 523 - protein, 18 aa, Human severe acute respiratory syndrome virus
YTERIVRQSRVRPLGAWL

SEQ ID NO: 524 - protein, 12 aa, Human severe acute respiratory syndrome virus
AYINEVLCQDWT

SEQ ID NO: 525 - protein, 6 aa, Human severe acute respiratory syndrome virus
KNVLSV

SEQ ID NO: 526 - protein, 22 aa, Human severe acute respiratory syndrome virus
QTCNLLFYFIRYLCLLESFCGF

SEQ ID NO: 527 - protein, 4 aa, Human severe acute respiratory syndrome virus
PIYD

SEQ ID NO: 528 - protein, 8 aa, Human severe acute respiratory syndrome virus
CSAVGLYG

SEQ ID NO: 529 - protein, 12 aa, Human severe acute respiratory syndrome virus
PTLPGTWKCTCG

SEQ ID NO: 530 - protein, 4 aa, Human severe acute respiratory syndrome virus
CYHD

SEQ ID NO: 531 - protein, 5 aa, Human severe acute respiratory syndrome virus
MFSSP

SEQ ID NO: 532 - protein, 6 aa, Human severe acute respiratory syndrome virus
IPYYRR

SEQ ID NO: 533 - protein, 17 aa, Human severe acute respiratory syndrome virus
FCLQKSTTHGCEVCIAC

SEQ ID NO: 534 - protein, 5 aa, Human severe acute respiratory syndrome virus
VSSSS

SEQ ID NO: 535 - protein, 13 aa, Human severe acute respiratory syndrome virus
HWKSKGYQVCASG

SEQ ID NO: 536 - protein, 11 aa, Human severe acute respiratory syndrome virus
SRMEVLRCSAM

SEQ ID NO: 537 - protein, 17 aa, Human severe acute respiratory syndrome virus
QSLQNRGALLFLCYTSR

SEQ ID NO: 538 - protein, 8 aa, Human severe acute respiratory syndrome virus
WCLFVLEL

SEQ ID NO: 539 - protein, 9 aa, Human severe acute respiratory syndrome virus
SLPSQCNCV

SEQ ID NO: 540 - protein, 12 aa, Human severe acute respiratory syndrome virus
HKSLVKLELTRL

SEQ ID NO: 541 - protein, 4 aa, Human severe acute respiratory syndrome virus
FVCE

SEQ ID NO: 542 - protein, 9 aa, Human severe acute respiratory syndrome virus
ACIPHSSFR

SEQ ID NO: 543 - protein, 4 aa, Human severe acute respiratory syndrome virus
KCIY

SEQ ID NO: 544 - protein, 10 aa, Human severe acute respiratory syndrome virus
FKAIAFLLLF

SEQ ID NO: 545 - protein, 10 aa, Human severe acute respiratory syndrome virus
VSWQTSSVGY

SEQ ID NO: 546 - protein, 25 aa, Human severe acute respiratory syndrome virus
LCSTQICYVYYTMQFRWCCLQTPCK

SEQ ID NO: 547 - protein, 8 aa, Human severe acute respiratory syndrome virus
VPTVLGCI

SEQ ID NO: 548 - protein, 7 aa, Human severe acute respiratory syndrome virus
YDDFCWI

SEQ ID NO: 549 - protein, 7 aa, Human severe acute respiratory syndrome virus
PMDLQTI

SEQ ID NO: 550 - protein, 16 aa, Human severe acute respiratory syndrome virus
PVEYIYQVTEFRKCGL

SEQ ID NO: 551 - protein, 11 aa, Human severe acute respiratory syndrome virus
WTRRRSTCFHH

SEQ ID NO: 552 - protein, 9 aa, Human severe acute respiratory syndrome virus
CCLHKGRWY

SEQ ID NO: 553 - protein, 4 aa, Human severe acute respiratory syndrome virus
CGDL

SEQ ID NO: 554 - protein, 5 aa, Human severe acute respiratory syndrome virus
DNTSC

SEQ ID NO: 555 - protein, 5 aa, Human severe acute respiratory syndrome virus
TSARD

SEQ ID NO: 556 - protein, 23 aa, Human severe acute respiratory syndrome virus
YCNLGLQKRSPSTCIYNRCLHND

SEQ ID NO: 557 - protein, 6 aa, Human severe acute respiratory syndrome virus
HCQETY

SEQ ID NO: 558 - protein, 10 aa, Human severe acute respiratory syndrome virus
ECLFFTYCLV

SEQ ID NO: 559 - protein, 8 aa, Human severe acute respiratory syndrome virus
SGRTGRPF

SEQ ID NO: 560 - protein, 21 aa, Human severe acute respiratory syndrome virus
WCFNNRRFSQRSNTFKGTSTS

SEQ ID NO: 561 - protein, 15 aa, Human severe acute respiratory syndrome virus
RQWSHINWRISKNTV

SEQ ID NO: 562 - protein, 10 aa, Human severe acute respiratory syndrome virus
ESRRHYSTVA

SEQ ID NO: 563 - protein, 12 aa, Human severe acute respiratory syndrome virus
NLLYSEQRLRGF

SEQ ID NO: 564 - protein, 7 aa, Human severe acute respiratory syndrome virus
AQITNGN

SEQ ID NO: 565 - protein, 7 aa, Human severe acute respiratory syndrome virus
LSRARYG

SEQ ID NO: 566 - protein, 5 aa, Human severe acute respiratory syndrome virus
IHTAI

SEQ ID NO: 567 - protein, 37 aa, Human severe acute respiratory syndrome virus
ARGLCLRTHRLWRFQSWTTWRSSFNDRLSQALTRFTT

SEQ ID NO: 568 - protein, 31 aa, Human severe acute respiratory syndrome virus
IRGFYPYGQHSEKLLHNRCANRFIKMCVFCD

SEQ ID NO: 569 - protein, 21 aa, Human severe acute respiratory syndrome virus
LCRDNKVTRFVSDFKSGQGYN

SEQ ID NO: 570 - protein, 7 aa, Human severe acute respiratory syndrome virus
NFIHALV

SEQ ID NO: 571 - protein, 4 aa, Human severe acute respiratory syndrome virus
GWTC

SEQ ID NO: 572 - protein, 19 aa, Human severe acute respiratory syndrome virus
NLLPKTTSKSSVATRCCDA

SEQ ID NO: 573 - protein, 9 aa, Human severe acute respiratory syndrome virus
LVQDAKNAS

SEQ ID NO: 574 - protein, 5 aa, Human severe acute respiratory syndrome virus
PSELW

SEQ ID NO: 575 - protein, 42 aa, Human severe acute respiratory syndrome virus
KCCYTKRNNDECRKVYSTVSILKYTYFSCTLQHESYSLWCWL

SEQ ID NO: 576 - protein, 24 aa, Human severe acute respiratory syndrome virus
RSCTRYSCAQTMVANWHTTCRFRS

SEQ ID NO: 577 - protein, 19 aa, Human severe acute respiratory syndrome virus
LRLRRRFYFNWRLCNSTYG

SEQ ID NO: 578 - protein, 5 aa, Human severe acute respiratory syndrome virus
MGPYY

SEQ ID NO: 579 - protein, 8 aa, Human severe acute respiratory syndrome virus
DQTCDKRE

SEQ ID NO: 580 - protein, 32 aa, Human severe acute respiratory syndrome virus
RRVFHLSVWIYKAKTSPGWFYSCKDNRAFLEC

SEQ ID NO: 581 - protein, 30 aa, Human severe acute respiratory syndrome virus
PLQAYGPFLMVDSFCYKCKCIIIGSIFNWG

SEQ ID NO: 582 - protein, 9 aa, Human severe acute respiratory syndrome virus
LSWQAEGTN

SEQ ID NO: 583 - protein, 6 aa, Human severe acute respiratory syndrome virus
WLYHAC

SEQ ID NO: 584 - protein, 18 aa, Human severe acute respiratory syndrome virus
LHFLEEHKSYPVVFLFTL

SEQ ID NO: 585 - protein, 6 aa, Human severe acute respiratory syndrome virus
HEQISS

SEQ ID NO: 586 - protein, 9 aa, Human severe acute respiratory syndrome virus
IKRNCCNVS

SEQ ID NO: 587 - protein, 5 aa, Human severe acute respiratory syndrome virus
GESNQ

SEQ ID NO: 588 - protein, 9 aa, Human severe acute respiratory syndrome virus
YDLFSSGKR

SEQ ID NO: 589 - protein, 9 aa, Human severe acute respiratory syndrome virus
RKQQSCGFK

SEQ ID NO: 590 - protein, 15 aa, Human severe acute respiratory syndrome virus
QLNEHVYFLIISYSH

SEQ ID NO: 591 - protein, 5 aa, Human severe acute respiratory syndrome virus
PVHHF

SEQ ID NO: 592 - protein, 4 aa, Human severe acute respiratory syndrome virus
CSSS

SEQ ID NO: 593 - protein, 14 aa, Human severe acute respiratory syndrome virus
LHSTYFIYEGGLLS

SEQ ID NO: 594 - protein, 16 aa, Human severe acute respiratory syndrome virus
IRHSLFNSGFISSILF

SEQ ID NO: 595 - protein, 7 aa, Human severe acute respiratory syndrome virus
CYRVSYY

SEQ ID NO: 596 - protein, 6 aa, Human severe acute respiratory syndrome virus
QPCHTF

SEQ ID NO: 597 - protein, 33 aa, Human severe acute respiratory syndrome virus
GWYLFCCHREIKCCPWLGFWFYHEQQVTVGDYY

SEQ ID NO: 598 - protein, 6 aa, Human severe acute respiratory syndrome virus
CCYTSM

SEQ ID NO: 599 - protein, 7 aa, Human severe acute respiratory syndrome virus
QPFLCCF

SEQ ID NO: 600 - protein, 12 aa, Human severe acute respiratory syndrome virus
THGYTDTYYDIR

SEQ ID NO: 601 - protein, 7 aa, Human severe acute respiratory syndrome virus
LHFRVHI

SEQ ID NO: 602 - protein, 4 aa, Human severe acute respiratory syndrome virus
CLFA

SEQ ID NO: 603 - protein, 6 aa, Human severe acute respiratory syndrome virus
CFRKVR

SEQ ID NO: 604 - protein, 7 aa, Human severe acute respiratory syndrome virus
TLTRVCV

SEQ ID NO: 605 - protein, 7 aa, Human severe acute respiratory syndrome virus
RWVSLCL

SEQ ID NO: 606 - protein, 9 aa, Human severe acute respiratory syndrome virus
GLSTYRCSS

SEQ ID NO: 607 - protein, 5 aa, Human severe acute respiratory syndrome virus
STFWF

SEQ ID NO: 608 - protein, 6 aa, Human severe acute respiratory syndrome virus
HFETYF

SEQ ID NO: 609 - protein, 5 aa, Human severe acute respiratory syndrome virus
VASWY

SEQ ID NO: 610 - protein, 4 aa, Human severe acute respiratory syndrome virus
HYKF

SEQ ID NO: 611 - protein, 34 aa, Human severe acute respiratory syndrome virus
SHSYSLFTCSRHLGHVSCSLFCWLFKANYIYAQV

SEQ ID NO: 612 - protein, 8 aa, Human severe acute respiratory syndrome virus
KWYNHRCC

SEQ ID NO: 613 - protein, 7 aa, Human severe acute respiratory syndrome virus
LFSKSTC

SEQ ID NO: 614 - protein, 5 aa, Human severe acute respiratory syndrome virus
TQMLC

SEQ ID NO: 615 - protein, 7 aa, Human severe acute respiratory syndrome virus
QRNLPDL

SEQ ID NO: 616 - protein, 13 aa, Human severe acute respiratory syndrome virus
FQGCSLRRCCEIP

SEQ ID NO: 617 - protein, 11 aa, Human severe acute respiratory syndrome virus
YYKLVSFWRGF

SEQ ID NO: 618 - protein, 13 aa, Human severe acute respiratory syndrome virus
IPFCLCMGEKKNF

SEQ ID NO: 619 - protein, 13 aa, Human severe acute respiratory syndrome virus
LLCALQLNIFFNL

SEQ ID NO: 620 - protein, 7 aa, Human severe acute respiratory syndrome virus
VLWRFCH

SEQ ID NO: 621 - protein, 16 aa, Human severe acute respiratory syndrome virus
SLLLQCLCRFFCSQGR

SEQ ID NO: 622 - protein, 13 aa, Human severe acute respiratory syndrome virus
CKTNSARTNWCYC

SEQ ID NO: 623 - protein, 10 aa, Human severe acute respiratory syndrome virus
FHGLCPCLEY

SEQ ID NO: 624 - protein, 5 aa, Human severe acute respiratory syndrome virus
CYFNW

SEQ ID NO: 625 - protein, 4 aa, Human severe acute respiratory syndrome virus
TWQA

SEQ ID NO: 626 - protein, 4 aa, Human severe acute respiratory syndrome virus
ERHI

SEQ ID NO: 627 - protein, 5 aa, Human severe acute respiratory syndrome virus
CAFLP

SEQ ID NO: 628 - protein, 9 aa, Human severe acute respiratory syndrome virus
WQTLHPTCS

SEQ ID NO: 629 - protein, 6 aa, Human severe acute respiratory syndrome virus
LLLAIK

SEQ ID NO: 630 - protein, 21 aa, Human severe acute respiratory syndrome virus
LWFLHHYWHWLPTLQSCSTFF

SEQ ID NO: 631 - protein, 15 aa, Human severe acute respiratory syndrome virus
TFKCTGHGLWTKIIH

SEQ ID NO: 632 - protein, 6 aa, Human severe acute respiratory syndrome virus
EPVCQF

SEQ ID NO: 633 - protein, 23 aa, Human severe acute respiratory syndrome virus
WTHWYWCVNSFFKEISTISTIWP

SEQ ID NO: 634 - protein, 5 aa, Human severe acute respiratory syndrome virus
FRSRS

SEQ ID NO: 635 - protein, 23 aa, Human severe acute respiratory syndrome virus
NIRHFTLLFWGCKCNYTWNKCFI

SEQ ID NO: 636 - protein, 8 aa, Human severe acute respiratory syndrome virus
SCCSISRC

SEQ ID NO: 637 - protein, 34 aa, Human severe acute respiratory syndrome virus
CFYSNSCRSTHTSLAHIFYWKQCIPDSSRLSYRS

SEQ ID NO: 638 - protein, 6 aa, Human severe acute respiratory syndrome virus
ACRHFL

SEQ ID NO: 639 - protein, 11 aa, Human severe acute respiratory syndrome virus
VRHSYWSWHLC

SEQ ID NO: 640 - protein, 8 aa, Human severe acute respiratory syndrome virus
LPYSFFIT

SEQ ID NO: 641 - protein, 13 aa, Human severe acute respiratory syndrome virus
PKIYCGLYYVFRC

SEQ ID NO: 642 - protein, 5 aa, Human severe acute respiratory syndrome virus
FNCLL

SEQ ID NO: 643 - protein, 6 aa, Human severe acute respiratory syndrome virus
HHCYTY

SEQ ID NO: 644 - protein, 11 aa, Human severe acute respiratory syndrome virus
HYYRSNACFYG

SEQ ID NO: 645 - protein, 5 aa, Human severe acute respiratory syndrome virus
NLRRL

SEQ ID NO: 646 - protein, 8 aa, Human severe acute respiratory syndrome virus
YVHLRRFY

SEQ ID NO: 647 - protein, 6 aa, Human severe acute respiratory syndrome virus
FASPIW

SEQ ID NO: 648 - protein, 14 aa, Human severe acute respiratory syndrome virus
LLHTTKSCTLRYCC

SEQ ID NO: 649 - protein, 6 aa, Human severe acute respiratory syndrome virus
TGSQHT

SEQ ID NO: 650 - protein, 20 aa, Human severe acute respiratory syndrome virus
SVRSSQTNVQNPNFEIFWWF

SEQ ID NO: 651 - protein, 6 aa, Human severe acute respiratory syndrome virus
FFTNIT

SEQ ID NO: 652 - protein, 5 aa, Human severe acute respiratory syndrome virus
PSKAN

SEQ ID NO: 653 - protein, 4 aa, Human severe acute respiratory syndrome virus
EVFY

SEQ ID NO: 654 - protein, 4 aa, Human severe acute respiratory syndrome virus
GLAL

SEQ ID NO: 655 - protein, 4 aa, Human severe acute respiratory syndrome virus
GDTR

SEQ ID NO: 656 - protein, 12 aa, Human severe acute respiratory syndrome virus
CWLHEAIWRMPR

SEQ ID NO: 657 - protein, 19 aa, Human severe acute respiratory syndrome virus
RSHLCAEVQWTYSVATSAH

SEQ ID NO: 658 - protein, 10 aa, Human severe acute respiratory syndrome virus
YDCCLHCCSS

SEQ ID NO: 659 - protein, 25 aa, Human severe acute respiratory syndrome virus
WYCHCWMDIWCWRCSSNTFCYANGI

SEQ ID NO: 660 - protein, 12 aa, Human severe acute respiratory syndrome virus
VQWHWSYPKCSL

SEQ ID NO: 661 - protein, 9 aa, Human severe acute respiratory syndrome virus
EPKTNRQPI

SEQ ID NO: 662 - protein, 20 aa, Human severe acute respiratory syndrome virus
SNSRITYNNINCIGQAARRC

SEQ ID NO: 663 - protein, 10 aa, Human severe acute respiratory syndrome virus
PECSSIKHTC

SEQ ID NO: 664 - protein, 9 aa, Human severe acute respiratory syndrome virus
FWCNFKCAK

SEQ ID NO: 665 - protein, 5 aa, Human severe acute respiratory syndrome virus
YPFAT

SEQ ID NO: 666 - protein, 7 aa, Human severe acute respiratory syndrome virus
SRGGGTN

SEQ ID NO: 667 - protein, 22 aa, Human severe acute respiratory syndrome virus
QVNYRQTSKPSNLCNTTTNQGC

SEQ ID NO: 668 - protein, 5 aa, Human severe acute respiratory syndrome virus
NQGFC

SEQ ID NO: 669 - protein, 4 aa, Human severe acute respiratory syndrome virus
SCCY

SEQ ID NO: 670 - protein, 9 aa, Human severe acute respiratory syndrome virus
VCSWTIKKS

SEQ ID NO: 671 - protein, 42 aa, Human severe acute respiratory syndrome virus
LLWKGLPPYVLPTSSPAWCCLPTCHVCAIPGEELHHSASNLS

SEQ ID NO: 672 - protein, 7 aa, Human severe acute respiratory syndrome virus
RQSILPS

SEQ ID NO: 673 - protein, 5 aa, Human severe acute respiratory syndrome virus
RCFCV

SEQ ID NO: 674 - protein, 28 aa, Human severe acute respiratory syndrome virus
WHFLVYYTEELLFSTNNYYRQYICLRKL

SEQ ID NO: 675 - protein, 6 aa, Human severe acute respiratory syndrome virus
CRYWHH

SEQ ID NO: 676 - protein, 4 aa, Human severe acute respiratory syndrome virus
QHSL

SEQ ID NO: 677 - protein, 4 aa, Human severe acute respiratory syndrome virus
SSAT

SEQ ID NO: 678 - protein, 18 aa, Human severe acute respiratory syndrome virus
LIQRRAGQVLQKSYITRC

SEQ ID NO: 679 - protein, 7 aa, Human severe acute respiratory syndrome virus
SWRHFRH

SEQ ID NO: 680 - protein, 10 aa, Human severe acute respiratory syndrome virus
RFCRQHSKRN

SEQ ID NO: 681 - protein, 7 aa, Human severe acute respiratory syndrome virus
PSRIGKI

SEQ ID NO: 682 - protein, 27 aa, Human severe acute respiratory syndrome virus
MALVCLARLHCWTNCHRHGYNLALLHD

SEQ ID NO: 683 - protein, 17 aa, Human severe acute respiratory syndrome virus
LLQLPQGCMLLWFLLQV

SEQ ID NO: 684 - protein, 289 aa, Human severe acute respiratory syndrome virus
ASSQGCQITLHINELMDLFMRFFTLGSITAQPVKIDNASPASTVHATATIPLQASLPFGWLVIGVAFLAVFQSATKIIALNKRWQLALYKGFQFICNLLLLFVTIYSHLLLVAAGMEAQFLYLYALIYFLQCINACRIIMRCWLCWKCKSKNPLLYDANYFVCWHTHNYDYCIPYNSVTDTIVVTEGDGISTPKLKEDYQIGGYSEDRHSGVKDYVVVHGYFTEVYYQLESTQITTDTGIENATFFIFNKLVKDPPNVQIHTIDGSSGVANPAMDPIYDEPTTTTSVPL

SEQ ID NO: 685 - protein, 84 aa, Human severe acute respiratory syndrome virus
AQESEYELMYSFVSEETGTLIVNSVLLFLAFVVFLLVTLAILTALRLCAYCCNIVNVSLVKPTVYVYSRVKNLNSSEGVPDLLV

SEQ ID NO: 686 - protein, 9 aa, Human severe acute respiratory syndrome virus
LLLLFCLEL

SEQ ID NO: 687 - protein, 24 aa, Human severe acute respiratory syndrome virus
HCLSWQTTVLLPLRSLNNSWNNGT

SEQ ID NO: 688 - protein, 4 aa, Human severe acute respiratory syndrome virus
VSYS

SEQ ID NO: 689 - protein, 18 aa, Human severe acute respiratory syndrome virus
PGLCYYNLPILIGTGFCT

SEQ ID NO: 690 - protein, 10 aa, Human severe acute respiratory syndrome virus
SLFSSGSCGQ

SEQ ID NO: 691 - protein, 15 aa, Human severe acute respiratory syndrome virus
HLLVLCLLLSTELIG

SEQ ID NO: 692 - protein, 11 aa, Human severe acute respiratory syndrome virus
LAGLRLQWLVL

SEQ ID NO: 693 - protein, 38 aa, Human severe acute respiratory syndrome virus
CGLATSLLPSGCLLVPAQCGHSTQKQTFFSMCLSGGQL

SEQ ID NO: 694 - protein, 13 aa, Human severe acute respiratory syndrome virus
PDRSWKVNLSLVL

SEQ ID NO: 695 - protein, 12 aa, Human severe acute respiratory syndrome virus
SFVVTCEWPDTP

SEQ ID NO: 696 - protein, 24 aa, Human severe acute respiratory syndrome virus
GAVTLRTCQKRSLWLHHERFLITN

SEQ ID NO: 697 - protein, 5 aa, Human severe acute respiratory syndrome virus
ERRSV

SEQ ID NO: 698 - protein, 18 aa, Human severe acute respiratory syndrome virus
ALIQVLLHTTATVLETIN

SEQ ID NO: 699 - protein, 13 aa, Human severe acute respiratory syndrome virus
IQTTPVATTILLC

SEQ ID NO: 700 - protein, 65 aa, Human severe acute respiratory syndrome virus
QQMFHLVDFQVTIAEILIIIMRTFRIAIWNLDVIISSIVRQLFKPLTKKNYSELDDEEPMELDYP

SEQ ID NO: 701 - protein, 26 aa, Human severe acute respiratory syndrome virus
NEHENYSLPDIDCIYILRAISLSGVC

SEQ ID NO: 702 - protein, 25 aa, Human severe acute respiratory syndrome virus
RYDCTTKRTLPIRNIRGQFTISPSC

SEQ ID NO: 703 - protein, 6 aa, Human severe acute respiratory syndrome virus
ICTNLH

SEQ ID NO: 704 - protein, 8 aa, Human severe acute respiratory syndrome virus
HTLCFCLC

SEQ ID NO: 705 - protein, 48 aa, Human severe acute respiratory syndrome virus
RYSTYLSAACKISFTKTFHQTRGGSTRALLATFSHCCCSSIFNTLLHH

SEQ ID NO: 706 - protein, 48 aa, Human severe acute respiratory syndrome virus
EKDRMNELTLIDFYLCFLAFLLFLVLIMLIIFWFSLEIQDLEEPCTKV

SEQ ID NO: 707 - protein, 41 aa, Human severe acute respiratory syndrome virus
TNMKLLIVLTCISLCSCIRTVVQRCASNKPHVLEDPCKVQH

SEQ ID NO: 708 - protein, 14 aa, Human severe acute respiratory syndrome virus
HCLALCSRKGFTFS

SEQ ID NO: 709 - protein, 10 aa, Human severe acute respiratory syndrome virus
MAHYGSNMHT

SEQ ID NO: 710 - protein, 15 aa, Human severe acute respiratory syndrome virus
CYYQLSRSSWWCAYS

SEQ ID NO: 711 - protein, 5 aa, Human severe acute respiratory syndrome virus
VLVPS

SEQ ID NO: 712 - protein, 7 aa, Human severe acute respiratory syndrome virus
RSPNCCI

SEQ ID NO: 713 - protein, 7 aa, Human severe acute respiratory syndrome virus
RRTCCFK

SEQ ID NO: 714 - protein, 106 aa, Human severe acute respiratory syndrome virus
TNKLKCLIMDPNQTNVVPPALHLVDPQIQLTITRMEDAMGQGQNSADPKVYPIILRLGSQLSLSMARRNLDSLEARAFQSTPIVVQMTKLATTEELPDEFVVVTAK

SEQ ID NO: 715 - protein, 11 aa, Human severe acute respiratory syndrome virus
KSSAPDGTSIT

SEQ ID NO: 716 - protein, 25 aa, Human severe acute respiratory syndrome virus
ELAQKLHFPTALTKKASYGLQLREP

SEQ ID NO: 717 - protein, 84 aa, Human severe acute respiratory syndrome virus
IHPKTTLAPAILITMLPPCYNFLKEQHCQKASTQREAEAAVKPLLAPHHVVAVIQEIQLLAAVGEILLLEWLAEVVKLPSRYCC

SEQ ID NO: 718 - protein, 63 aa, Human severe acute respiratory syndrome virus
TSLRAKFLVKANNNKAKLSLRNLLLRHLKSLAKNVLPQNSTTSLKHLGDVVQNKPKEISGTKT

SEQ ID NO: 719 - protein, 39 aa, Human severe acute respiratory syndrome virus
SDKELITNIGRKLHNLLQVPLHSLECHALAWKSHLREHG

SEQ ID NO: 720 - protein, 21 aa, Human severe acute respiratory syndrome virus
LIMEPLNWMTKIHNSKTTSYC

SEQ ID NO: 721 - protein, 38 aa, Human severe acute respiratory syndrome virus
TSTLTHTKHSHQQSLKRTKRKRLMKLSLCRRDKRSSPL

SEQ ID NO: 722 - protein, 18 aa, Human severe acute respiratory syndrome virus
LFFLRLTWMISPDNFKIP

SEQ ID NO: 723 - protein, 13 aa, Human severe acute respiratory syndrome virus
VELLLIQLRHKHS

SEQ ID NO: 724 - protein, 18 aa, Human severe acute respiratory syndrome virus
PHKADGLCKRFRNSVYDT

SEQ ID NO: 725 - protein, 9 aa, Human severe acute respiratory syndrome virus
STLVQNEFS

SEQ ID NO: 726 - protein, 8 aa, Human severe acute respiratory syndrome virus
LNSTSRFS

SEQ ID NO: 727 - protein, 15 aa, Human severe acute respiratory syndrome virus
SHIAIFNQCVTLGRT

SEQ ID NO: 728 - protein, 43 aa, Human severe acute respiratory syndrome virus
KSHHIFIEATRSTIEGTVNNARESCLYGRALMCKINFSSAIPM

SEQ ID NO: 729 - protein, 13 aa, Human severe acute respiratory syndrome virus
LLRRMTKKKKKKK

SEQ ID NO: 730 - DNA, 29736 bp, Human severe acute respiratory syndrome virus; identical to SEQ ID NO: 4
  CDS (3)..(29735)

SEQ ID NO: 731 - protein, 11 aa, Human severe acute respiratory syndrome virus
TQEKPTNLDLL

SEQ ID NO: 732 - protein, 7 aa, Human severe acute respiratory syndrome virus
ICSLNEL

SEQ ID NO: 733 - protein, 25 aa, Human severe acute respiratory syndrome virus
NLCSCRSAACLVHLRSINNNKFYCR

SEQ ID NO: 734 - protein, 35 aa, Human severe acute respiratory syndrome virus
QETSNSSLFCRLLTVSSVLQSIISIPRFRPGVTER

SEQ ID NO: 735 - protein, 23 aa, Human severe acute respiratory syndrome virus
DGEPCSWCQRENTRPTQFACPSG

SEQ ID NO: 736 - protein, 19 aa, Human severe acute respiratory syndrome virus
RRASAWLRGLCGRGPIGGT

SEQ ID NO: 737 - protein, 20 aa, Human severe acute respiratory syndrome virus
TPQKWHLWSSRAGKRRTAPA

SEQ ID NO: 738 - protein, 6 aa, Human severe acute respiratory syndrome virus
TALCVH

SEQ ID NO: 739 - protein, 11 aa, Human severe acute respiratory syndrome virus
CLKHQSRPQGR

SEQ ID NO: 740 - protein, 12 aa, Human severe acute respiratory syndrome virus
AGCRNGRHSVRS

SEQ ID NO: 741 - protein, 24 aa, Human severe acute respiratory syndrome virus
RYNTGSTRATCGRNPNCIPQCSSS

SEQ ID NO: 742 - protein, 5 aa, Human severe acute respiratory syndrome virus
GSRWS

SEQ ID NO: 743 - protein, 8 aa, Human severe acute respiratory syndrome virus
LWHRSKVL

SEQ ID NO: 744 - protein, 4 aa, Human severe acute respiratory syndrome virus
RAWH

SEQ ID NO: 745 - protein, 5 aa, Human severe acute respiratory syndrome virus
TKLEH

SEQ ID NO: 746 - protein, 7 aa, Human severe acute respiratory syndrome virus
AWQWCTP

SEQ ID NO: 747 - protein, 22 aa, Human severe acute respiratory syndrome virus
AQWRCSHSLCRQQFLWPRWVPS

SEQ ID NO: 748 - protein, 20 aa, Human severe acute respiratory syndrome virus
LHQRFSRTRGQVNVHSFRTT

SEQ ID NO: 749 - protein, 12 aa, Human severe acute respiratory syndrome virus
LHRVEERCLLLP

SEQ ID NO: 750 - protein, 5 aa, Human severe acute respiratory syndrome virus
NCLVH

SEQ ID NO: 751 - protein, 10 aa, Human severe acute respiratory syndrome virus
ELRAPDTLRN

SEQ ID NO: 752 - protein, 5 aa, Human severe acute respiratory syndrome virus
ECQEI

SEQ ID NO: 753 - protein, 13 aa, Human severe acute respiratory syndrome virus
HFQRGMPKVCVSS

SEQ ID NO: 754 - protein, 10 aa, Human severe acute respiratory syndrome virus
LKSQSHSTTC

SEQ ID NO: 755 - protein, 4 aa, Human severe acute respiratory syndrome virus
KEKD

SEQ ID NO: 756 - protein, 18 aa, Human severe acute respiratory syndrome virus
GFHGAYTLCVPCCISTGV

SEQ ID NO: 757 - protein, 10 aa, Human severe acute respiratory syndrome virus
QYALVYLDEM

SEQ ID NO: 758 - protein, 13 aa, Human severe acute respiratory syndrome virus
SFMADVRLSESHL

SEQ ID NO: 759 - protein, 4 aa, Human severe acute respiratory syndrome virus
TLWH

SEQ ID NO: 760 - protein, 4 aa, Human severe acute respiratory syndrome virus
KFSY

SEQ ID NO: 761 - protein, 10 aa, Human severe acute respiratory syndrome virus
RTYYMWVPTY

SEQ ID NO: 762 - protein, 17 aa, Human severe acute respiratory syndrome virus
CCSENAMSCLSRPRDWT

SEQ ID NO: 763 - protein, 10 aa, Human severe acute respiratory syndrome virus
CCRLSQPLKH

SEQ ID NO: 764 - protein, 7 aa, Human severe acute respiratory syndrome virus
NSTPQGR

SEQ ID NO: 765 - protein, 13 aa, Human severe acute respiratory syndrome virus
MFWRLCVCLCWLL

SEQ ID NO: 766 - protein, 8 aa, Human severe acute respiratory syndrome virus
ACLLGSSC

SEQ ID NO: 767 - protein, 10 aa, Human severe acute respiratory syndrome virus
YWLRPYWHYW

SEQ ID NO: 768 - protein, 6 aa, Human severe acute respiratory syndrome virus
QCGDLE

SEQ ID NO: 769 - protein, 4 aa, Human severe acute respiratory syndrome virus
DTES

SEQ ID NO: 770 - protein, 8 aa, Human severe acute respiratory syndrome virus
HCWRFSFE

SEQ ID NO: 771 - protein, 17 aa, Human severe acute respiratory syndrome virus
RGCHHFGIFLCFYKCLY

SEQ ID NO: 772 - protein, 5 aa, Human severe acute respiratory syndrome virus
HYKES

SEQ ID NO: 773 - protein, 8 aa, Human severe acute respiratory syndrome virus
LQVFQNHC

SEQ ID NO: 774 - protein, 42 aa, Human severe acute respiratory syndrome virus
SYQGKARKRCLEHWTTEISFNTTVWFSLTGCWCYQINFCAHT

SEQ ID NO: 775 - protein, 7 aa, Human severe acute respiratory syndrome virus
CSKPLNS

SEQ ID NO: 776 - protein, 9 aa, Human severe acute respiratory syndrome virus
FAKSSCHHT

SEQ ID NO: 777 - protein, 39 aa, Human severe acute respiratory syndrome virus
TVITSCRRHGLYFRPAHQQCHYYGICNWWSCTTDFSVVV

SEQ ID NO: 778 - protein, 6 aa, Human severe acute respiratory syndrome virus
SFGHYC

SEQ ID NO: 779 - protein, 6 aa, Human severe acute respiratory syndrome virus
KTQAYL

SEQ ID NO: 780 - protein, 17 aa, Human severe acute respiratory syndrome virus
ISQGCLGDSQISHYRCF

SEQ ID NO: 781 - protein, 11 aa, Human severe acute respiratory syndrome virus
HRQGSNTGCFR

SEQ ID NO: 782 - protein, 9 aa, Human severe acute respiratory syndrome virus
HQGLCKMLH

SEQ ID NO: 783 - protein, 7 aa, Human severe acute respiratory syndrome virus
QGTRNVH

SEQ ID NO: 784 - protein, 15 aa, Human severe acute respiratory syndrome virus
SSHYRWRKVAITQLR

SEQ ID NO: 785 - protein, 26 aa, Human severe acute respiratory syndrome virus
SLHRSKQGTLPSVYTWQGAAATTHAS

SEQ ID NO: 786 - protein, 8 aa, Human severe acute respiratory syndrome virus
GTKRSNLS

SEQ ID NO: 787 - protein, 5 aa, Human severe acute respiratory syndrome virus
HSTYL

SEQ ID NO: 788 - protein, 7 aa, Human severe acute respiratory syndrome virus
GGCSQER

SEQ ID NO: 789 - protein, 8 aa, Human severe acute respiratory syndrome virus
TRSTRDAR

SEQ ID NO: 790 - protein, 21 aa, Human severe acute respiratory syndrome virus
LHKWSYRWHTSLCKWPHALRD

SEQ ID NO: 791 - protein, 27 aa, Human severe acute respiratory syndrome virus
GQRTILRIVSWFTGYKQCLSLKRGCTN

SEQ ID NO: 792 - protein, 22 aa, Human severe acute respiratory syndrome virus
RCNLWRRYCLGSSRLQECENHI

SEQ ID NO: 793 - protein, 7 aa, Human severe acute respiratory syndrome virus
KVLCLHC

SEQ ID NO: 794 - protein, 6 aa, Human severe acute respiratory syndrome virus
IRYRSY

SEQ ID NO: 795 - protein, 17 aa, Human severe acute respiratory syndrome virus
VCMCCSRGCCEDFTTSF

SEQ ID NO: 796 - protein, 7 aa, Human severe acute respiratory syndrome virus
SPYQHGY

SEQ ID NO: 797 - protein, 9 aa, Human severe acute respiratory syndrome virus
VECSYILLI

SEQ ID NO: 798 - protein, 15 aa, Human severe acute respiratory syndrome virus
RKLFITYVLFLLPSR

SEQ ID NO: 799 - protein, 8 aa, Human severe acute respiratory syndrome virus
GRRGRCRV

SEQ ID NO: 800 - protein, 4 aa, Human severe acute respiratory syndrome virus
GRRN

SEQ ID NO: 801 - protein, 5 aa, Human severe acute respiratory syndrome virus
VRYRG

SEQ ID NO: 802 - protein, 12 aa, Human severe acute respiratory syndrome virus
LSRSPSGIWCLS

SEQ ID NO: 803 - protein, 4 aa, Human severe acute respiratory syndrome virus
NSSS

SEQ ID NO: 804 - protein, 9 aa, Human severe acute respiratory syndrome virus
GRRRGRLAG

SEQ ID NO: 805 - protein, 4 aa, Human severe acute respiratory syndrome virus
AIRD

SEQ ID NO: 806 - protein, 7 aa, Human severe acute respiratory syndrome virus
ARTRTYT

SEQ ID NO: 807 - protein, 9 aa, Human severe acute respiratory syndrome virus
SVYWLFKTY

SEQ ID NO: 808 - protein, 4 aa, Human severe acute respiratory syndrome virus
QCCH

SEQ ID NO: 809 - protein, 5 aa, Human severe acute respiratory syndrome virus
GGTKC

SEQ ID NO: 810 - protein, 8 aa, Human severe acute respiratory syndrome virus
SYGDCKCC

SEQ ID NO: 811 - protein, 25 aa, Human severe acute respiratory syndrome virus
HTPETWWWCSRCTQQGNQWCHAKGE

SEQ ID NO: 812 - protein, 16 aa, Human severe acute respiratory syndrome virus
AKWPSYSRRVLFAFWT

SEQ ID NO: 813 - protein, 8 aa, Human severe acute respiratory syndrome virus
EVSACCWT

SEQ ID NO: 814 - protein, 4 aa, Human severe acute respiratory syndrome virus
PKCR

SEQ ID NO: 815 - protein, 5 aa, Human severe acute respiratory syndrome virus
GHPAS

SEQ ID NO: 816 - protein, 20 aa, Human severe acute respiratory syndrome virus
KFQFTGHLTCTIVVSRHIWC

SEQ ID NO: 817 - protein, 21 aa, Human severe acute respiratory syndrome virus
TTSVFTSVRADGSYTGLYCSQ

SEQ ID NO: 818 - protein, 4 aa, Human severe acute respiratory syndrome virus
QSSL

SEQ ID NO: 819 - protein, 7 aa, Human severe acute respiratory syndrome virus
AGCHGLS

SEQ ID NO: 820 - protein, 4 aa, Human severe acute respiratory syndrome virus
SGST

SEQ ID NO: 821 - protein, 12 aa, Human severe acute respiratory syndrome virus
TRGATKHRRFQN

SEQ ID NO: 822 - protein, 15 aa, Human severe acute respiratory syndrome virus
GEICRTEACRCEAKN

SEQ ID NO: 823 - protein, 8 aa, Human severe acute respiratory syndrome virus
GYHNTGRN

SEQ ID NO: 824 - protein, 4 aa, Human severe acute respiratory syndrome virus
VSYQ

SEQ ID NO: 825 - protein, 5 aa, Human severe acute respiratory syndrome virus
VTLVC

SEQ ID NO: 826 - protein, 5 aa, Human severe acute respiratory syndrome virus
FSEHA

SEQ ID NO: 827 - protein, 5 aa, Human severe acute respiratory syndrome virus
RYVFP

SEQ ID NO: 828 - protein, 8 aa, Human severe acute respiratory syndrome virus
EGCTLHGR

SEQ ID NO: 829 - protein, 15 aa, Human severe acute respiratory syndrome virus
YHLCCNTLQKGWWHY

SEQ ID NO: 830 - protein, 11 aa, Human severe acute respiratory syndrome virus
DALKSFEESAS

SEQ ID NO: 831 - protein, 15 aa, Human severe acute respiratory syndrome virus
VYNHVPWTRMCWLYT

SEQ ID NO: 832 - protein, 14 aa, Human severe acute respiratory syndrome virus
EMQICILCTTFRST

SEQ ID NO: 833 - protein, 18 aa, Human severe acute respiratory syndrome virus
GRDSRNCILEFERNACSC

SEQ ID NO: 834 - protein, 12 aa, Human severe acute respiratory syndrome virus
RDKKINAYMHGC

SEQ ID NO: 835 - protein, 8 aa, Human severe acute respiratory syndrome virus
SHNGNHPT

SEQ ID NO: 836 - protein, 6 aa, Human severe acute respiratory syndrome virus
NSRGHR

SEQ ID NO: 837 - protein, 9 aa, Human severe acute respiratory syndrome virus
LWCPILLLY

SEQ ID NO: 838 - protein, 14 aa, Human severe acute respiratory syndrome virus
RACSFYYYEAELSK

SEQ ID NO: 839 - protein, 14 aa, Human severe acute respiratory syndrome virus
AACHNANWLCDTWF

SEQ ID NO: 840 - protein, 9 aa, Human severe acute respiratory syndrome virus
RGCALYAFS

SEQ ID NO: 841 - protein, 16 aa, Human severe acute respiratory syndrome virus
SSCRSVSIITRCCYYI

SEQ ID NO: 842 - protein, 10 aa, Human severe acute respiratory syndrome virus
WIPHFVIKDI

SEQ ID NO: 843 - protein, 27 aa, Human severe acute respiratory syndrome virus
GALCRNSFFGWLLQRLVLFRTAYRVRC

SEQ ID NO: 844 - protein, 15 aa, Human severe acute respiratory syndrome virus
QNCVPHSGEPRRVSS

SEQ ID NO: 845 - protein, 4 aa, Human severe acute respiratory syndrome virus
GSFT

SEQ ID NO: 846 - protein, 11 aa, Human severe acute respiratory syndrome virus
QTKESLIPAGG

SEQ ID NO: 847 - protein, 11 aa, Human severe acute respiratory syndrome virus
DYKSVHNCGQH

SEQ ID NO: 848 - protein, 24 aa, Human severe acute respiratory syndrome virus
SPHTACGYVYDIWTAVWSNILGWC

SEQ ID NO: 849 - protein, 4 aa, Human severe acute respiratory syndrome virus
CYKN

SEQ ID NO: 850 - protein, 5 aa, Human severe acute respiratory syndrome virus
TSCKS

SEQ ID NO: 851 - protein, 6 aa, Human severe acute respiratory syndrome virus
DFLCTT

SEQ ID NO: 852 - protein, 8 aa, Human severe acute respiratory syndrome virus
SFRVLPYS

SEQ ID NO: 853 - protein, 4 aa, Human severe acute respiratory syndrome virus
EFSW

SEQ ID NO: 854 - protein, 22 aa, Human severe acute respiratory syndrome virus
VHVCFKPHKEMEISSSWWFNFN

SEQ ID NO: 855 - protein, 5 aa, Human severe acute respiratory syndrome virus
QLLFV

SEQ ID NO: 856 - protein, 8 aa, Human severe acute respiratory syndrome virus
CFISTSTA

SEQ ID NO: 857 - protein, 13 aa, Human severe acute respiratory syndrome virus
SQIQCTSTSRGLL

SEQ ID NO: 858 - protein, 4 aa, Human severe acute respiratory syndrome virus
SPCW

SEQ ID NO: 859 - protein, 9 aa, Human severe acute respiratory syndrome virus
LLCTHTRLQ

SEQ ID NO: 860 - protein, 6 aa, Human severe acute respiratory syndrome virus
NCWRAW

SEQ ID NO: 861 - protein, 12 aa, Human severe acute respiratory syndrome virus
CQRNYDPSSTAC

SEQ ID NO: 862 - protein, 8 aa, Human severe acute respiratory syndrome virus
FGICKASS

SEQ ID NO: 863 - protein, 23 aa, Human severe acute respiratory syndrome virus
TLWSENYYLNGCRSCDVYGYSIL

SEQ ID NO: 864 - protein, 11 aa, Human severe acute respiratory syndrome virus
DRCFHSMCVWS

SEQ ID NO: 865 - protein, 20 aa, Human severe acute respiratory syndrome virus
CYTISSTTRVFFCYDVCTTC

SEQ ID NO: 866 - protein, 10 aa, Human severe acute respiratory syndrome virus
ITARYILMCE

SEQ ID NO: 867 - protein, 11 aa, Human severe acute respiratory syndrome virus
LSVWSLHSYNC

SEQ ID NO: 868 - protein, 6 aa, Human severe acute respiratory syndrome virus
GDPLSY

SEQ ID NO: 869 - protein, 15 aa, Human severe acute respiratory syndrome virus
RSSPYKDVRVQRTSD

SEQ ID NO: 870 - protein, 17 aa, Human severe acute respiratory syndrome virus
CFLQGNILHYNHQACVV

SEQ ID NO: 871 - protein, 9 aa, Human severe acute respiratory syndrome virus
TRWSYLHRD

SEQ ID NO: 872 - protein, 7 aa, Human severe acute respiratory syndrome virus
TKIGWVL

SEQ ID NO: 873 - protein, 21 aa, Human severe acute respiratory syndrome virus
CLLYRAAYRPCTNSTITKCEF

SEQ ID NO: 874 - protein, 6 aa, Human severe acute respiratory syndrome virus
FQTHMF

SEQ ID NO: 875 - protein, 4 aa, Human severe acute respiratory syndrome virus
HKIC

SEQ ID NO: 876 - protein, 30 aa, Human severe acute respiratory syndrome virus
FKSNDRLHKASFTRAICHILPRLEWRCSGY

SEQ ID NO: 877 - protein, 10 aa, Human severe acute respiratory syndrome virus
TLFSEFQERC

SEQ ID NO: 878 - protein, 6 aa, Human severe acute respiratory syndrome virus
ANCLAH

SEQ ID NO: 879 - protein, 30 aa, Human severe acute respiratory syndrome virus
PGYNQDNVQTKHLVFTLSLEYKASRYFKFI

SEQ ID NO: 880 - protein, 15 aa, Human severe acute respiratory syndrome virus
SSGSRRHTRNGQSCL

SEQ ID NO: 881 - protein, 6 aa, Human severe acute respiratory syndrome virus
KSTTHL

SEQ ID NO: 882 - protein, 15 aa, Human severe acute respiratory syndrome virus
RSSGKSYHTEGSHRV

SEQ ID NO: 883 - protein, 12 aa, Human severe acute respiratory syndrome virus
RENYRSCRQCHT

SEQ ID NO: 884 - protein, 7 aa, Human severe acute respiratory syndrome virus
SNTRVRS

SEQ ID NO: 885 - protein, 14 aa, Human severe acute respiratory syndrome virus
GSYGCLCGKHKHYH

SEQ ID NO: 886 - protein, 18 aa, Human severe acute respiratory syndrome virus
AFTSLRFKNNCHSWYCCN

SEQ ID NO: 887 - protein, 4 aa, Human severe acute respiratory syndrome virus
CSLE

SEQ ID NO: 888 - protein, 20 aa, Human severe acute respiratory syndrome virus
NFGLCQTILRTSSNYNIKLR

SEQ ID NO: 889 - protein, 7 aa, Human severe acute respiratory syndrome virus
EISTTCV

SEQ ID NO: 890 - protein, 17 aa, Human severe acute respiratory syndrome virus
QLYALCVYIIVPIVYFY

SEQ ID NO: 891 - protein, 4 aa, Human severe acute respiratory syndrome virus
KYQF

SEQ ID NO: 892 - protein, 8 aa, Human severe acute respiratory syndrome virus
SFTTYNYC

SEQ ID NO: 893 - protein, 7 aa, Human severe acute respiratory syndrome virus
IMFGCRH

SEQ ID NO: 894 - protein, 8 aa, Human severe acute respiratory syndrome virus
LCEVTQIF

SEQ ID NO: 895 - protein, 30 aa, Human severe acute respiratory syndrome virus
IVHNRYVAIVVKYLLRFSNLCNCCFWCTLI

SEQ ID NO: 896 - protein, 7 aa, Human severe acute respiratory syndrome virus
FWCSFLL

SEQ ID NO: 897 - protein, 4 aa, Human severe acute respiratory syndrome virus
RIVS

SEQ ID NO: 898 - protein, 7 aa, Human severe acute respiratory syndrome virus
RYYYGFL

SEQ ID NO: 899 - protein, 15 aa, Human severe acute respiratory syndrome virus
RFFSLQHLFKWIRLP

SEQ ID NO: 900 - protein, 5 aa, Human severe acute respiratory syndrome virus
FLSSS

SEQ ID NO: 901 - protein, 20 aa, Human severe acute respiratory syndrome virus
NHSGDDFIVQARLDNFRSGR

SEQ ID NO: 902 - protein, 29 aa, Human severe acute respiratory syndrome virus
VGFGIYVVHKILLFIRSFSYNAGVLWLFC

SEQ ID NO: 903 - protein, 13 aa, Human severe acute respiratory syndrome virus
SFHQQFLAHVVYH

SEQ ID NO: 904 - protein, 11 aa, Human severe acute respiratory syndrome virus
YCTNGTRFCNG

SEQ ID NO: 905 - protein, 31 aa, Human severe acute respiratory syndrome virus
DVHLLCFFLLHMEELCSYHGWLHLFDLHDVL

SEQ ID NO: 906 - protein, 7 aa, Human severe acute respiratory syndrome virus
AQSCHTR

SEQ ID NO: 907 - protein, 5 aa, Human severe acute respiratory syndrome virus
VYNYC

SEQ ID NO: 908 - protein, 27 aa, Human severe acute respiratory syndrome virus
WHEEIFLCLCKWRPWLLQDSQLELSQL

SEQ ID NO: 909 - protein, 5 aa, Human severe acute respiratory syndrome virus
HILHW

SEQ ID NO: 910 - protein, 5 aa, Human severe acute respiratory syndrome virus
FVTPV

SEQ ID NO: 911 - protein, 6 aa, Human severe acute respiratory syndrome virus
KTNQPY

SEQ ID NO: 912 - protein, 6 aa, Human severe acute respiratory syndrome virus
PVIVYC

SEQ ID NO: 913 - protein, 12 aa, Human severe acute respiratory syndrome virus
CCCEKWRASPLL

SEQ ID NO: 914 - protein, 7 aa, Human severe acute respiratory syndrome virus
QGWSKDL

SEQ ID NO: 915 - protein, 15 aa, Human severe acute respiratory syndrome virus
ETSSLPFCQFRQFES

SEQ ID NO: 916 - protein, 5 aa, Human severe acute respiratory syndrome virus
RFTAY

SEQ ID NO: 917 - protein, 4 aa, Human severe acute respiratory syndrome virus
CHSF

SEQ ID NO: 918 - protein, 10 aa, Human severe acute respiratory syndrome virus
WQVQMRRVCF

SEQ ID NO: 919 - protein, 17 aa, Human severe acute respiratory syndrome virus
VCFCVLQSADVPTYSVA

SEQ ID NO: 920 - protein, 9 aa, Human severe acute respiratory syndrome virus
PSSCIRRWR

SEQ ID NO: 921 - protein, 10 aa, Human severe acute respiratory syndrome virus
CLCRHLFSNF

SEQ ID NO: 922 - protein, 6 aa, Human severe acute respiratory syndrome virus
CSYGKT

SEQ ID NO: 923 - protein, 32 aa, Human severe acute respiratory syndrome virus
GTCCYSSQRVSKGCSFRWCPFYIRVSCPTRCC

SEQ ID NO: 924 - protein, 5 aa, Human severe acute respiratory syndrome virus
HKGCY

SEQ ID NO: 925 - protein, 8 aa, Human severe acute respiratory syndrome virus
MSQTFTSL

SEQ ID NO: 926 - protein, 5 aa, Human severe acute respiratory syndrome virus
LRSDR

SEQ ID NO: 927 - protein, 6 aa, Human severe acute respiratory syndrome virus
QFHAHL

SEQ ID NO: 928 - protein, 11 aa, Human severe acute respiratory syndrome virus
KHDAQRSWRMY

SEQ ID NO: 929 - protein, 27 aa, Human severe acute respiratory syndrome virus
CKAYQCPSSKKSQCFTHLECKRLHVFI

SEQ ID NO: 930 - protein, 9 aa, Human severe acute respiratory syndrome virus
CCQEEQHTF

SEQ ID NO: 931 - protein, 6 aa, Human severe acute respiratory syndrome virus
TNLCYN

SEQ ID NO: 932 - protein, 8 aa, Human severe acute respiratory syndrome virus
TGCQCHNY

SEQ ID NO: 933 - protein, 6 aa, Human severe acute respiratory syndrome virus
NLTQGW

SEQ ID NO: 934 - protein, 24 aa, Human severe acute respiratory syndrome virus
GHIIVRSCCIGLLYRYASTYIVNP

SEQ ID NO: 935 - protein, 4 aa, Human severe acute respiratory syndrome virus
WLHK

SEQ ID NO: 936 - protein, 13 aa, Human severe acute respiratory syndrome virus
NHWLQSHSGWCHS

SEQ ID NO: 937 - protein, 4 aa, Human severe acute respiratory syndrome virus
HHFY

SEQ ID NO: 938 - protein, 4 aa, Human severe acute respiratory syndrome virus
LFCK

SEQ ID NO: 939 - protein, 4 aa, Human severe acute respiratory syndrome virus
TCWF

SEQ ID NO: 940 - protein, 8 aa, Human severe acute respiratory syndrome virus
PAWWFIQK

SEQ ID NO: 941 - protein, 31 aa, Human severe acute respiratory syndrome virus
QKLPCSSCYHYKRDWFHSAWLTGYCAESNQW

SEQ ID NO: 942 - protein, 9 aa, Human severe acute respiratory syndrome virus
LLAFSTSCF

SEQ ID NO: 943 - protein, 13 aa, Human severe acute respiratory syndrome virus
CCWQHLLHTFQTH

SEQ ID NO: 944 - protein, 10 aa, Human severe acute respiratory syndrome virus
FCYLCLRSCC

SEQ ID NO: 945 - protein, 4 aa, Human severe acute respiratory syndrome virus
VYNF

SEQ ID NO: 946 - protein, 11 aa, Human severe acute respiratory syndrome virus
GCYGQTCAILL

SEQ ID NO: 947 - protein, 8 aa, Human severe acute respiratory syndrome virus
FARGFYFL

SEQ ID NO: 948 - protein, 18 aa, Human severe acute respiratory syndrome virus
ASSRHSLCAYGWFHHTVS

SEQ ID NO: 949 - protein, 7 aa, Human severe acute respiratory syndrome virus
HLPGGFC

SEQ ID NO: 950 - protein, 5 aa, Human severe acute respiratory syndrome virus
SSNNF

SEQ ID NO: 951 - protein, 17 aa, Human severe acute respiratory syndrome virus
TWYMRKVRSRYLPIYQW

SEQ ID NO: 952 - protein, 12 aa, Human severe acute respiratory syndrome virus
ALQSSIRSFLWC

SEQ ID NO: 953 - protein, 6 aa, Human severe acute respiratory syndrome virus
CDESHS

SEQ ID NO: 954 - protein, 43 aa, Human severe acute respiratory syndrome virus
HLYSSCATCGCFRCVCFSSGWWYYCHIGDLCCLLLYEIQTCFW

SEQ ID NO: 955 - protein, 7 aa, Human severe acute respiratory syndrome virus
VQPCCCC

SEQ ID NO: 956 - protein, 37 aa, Human severe acute respiratory syndrome virus
CTFVFDVFHYTLSGTSLQLSAGSLLSLLLVLDILFHQ

SEQ ID NO: 957 - protein, 38 aa, Human severe acute respiratory syndrome virus
CFILGSPSMVCHVFSYCAFLDNSNLCILYFSEALPLVL

SEQ ID NO: 958 - protein, 5 aa, Human severe acute respiratory syndrome virus
EKSHV

SEQ ID NO: 959 - protein, 4 aa, Human severe acute respiratory syndrome virus
WSYI

SEQ ID NO: 960 - protein, 21 aa, Human severe acute respiratory syndrome virus
YLRGGCFVYLFAQQGNVPKIA

SEQ ID NO: 961 - protein, 9 aa, Human severe acute respiratory syndrome virus
RDTVATYTV

SEQ ID NO: 962 - protein, 6 aa, Human severe acute respiratory syndrome virus
QVSCSI

SEQ ID NO: 963 - protein, 15 aa, Human severe acute respiratory syndrome virus
QVQVFQWSLRYYQLS

SEQ ID NO: 964 - protein, 11 aa, Human severe acute respiratory syndrome virus
SSLLPLSKGSK

SEQ ID NO: 965 - protein, 4 aa, Human severe acute respiratory syndrome virus
QLRC

SEQ ID NO: 966 - protein, 19 aa, Human severe acute respiratory syndrome virus
CSLPTTTDINHFCCSAEWF

SEQ ID NO: 967 - protein, 9 aa, Human severe acute respiratory syndrome virus
ENGIPVRQS

SEQ ID NO: 968 - protein, 13 aa, Human severe acute respiratory syndrome virus
RVHGTSNLWNYNS

SEQ ID NO: 969 - protein, 5 aa, Human severe acute respiratory syndrome virus
WIVVG

SEQ ID NO: 970 - protein, 16 aa, Human severe acute respiratory syndrome virus
HSILSKTCHLHSRRHA

SEQ ID NO: 971 - protein, 9 aa, Human severe acute respiratory syndrome virus
RSAHSQIQP

SEQ ID NO: 972 - protein, 22 aa, Human severe acute respiratory syndrome virus
LSCSGWQCSTSCYWPFYAKLSA

SEQ ID NO: 973 - protein, 4 aa, Human severe acute respiratory syndrome virus
DTQV

SEQ ID NO: 974 - protein, 30 aa, Human severe acute respiratory syndrome virus
ICPYPTWSNIFSSSMLQWFTIWCLSVCHET

SEQ ID NO: 975 - protein, 4 aa, Human severe acute respiratory syndrome virus
RFFP

SEQ ID NO: 976 - protein, 4 aa, Human severe acute respiratory syndrome virus
WIMW

SEQ ID NO: 977 - protein, 20 aa, Human severe acute respiratory syndrome virus
LRVFLLYASYGASNRSTRWY

SEQ ID NO: 978 - protein, 6 aa, Human severe acute respiratory syndrome virus
ILWSIC

SEQ ID NO: 979 - protein, 28 aa, Human severe acute respiratory syndrome virus
QTNCTGCRYRHNHNIKCFGMAVCCCYQW

SEQ ID NO: 980 - protein, 6 aa, Human severe acute respiratory syndrome virus
IHHYFE

SEQ ID NO: 981 - protein, 8 aa, Human severe acute respiratory syndrome virus
PCGNEVQL

SEQ ID NO: 982 - protein, 7 aa, Human severe acute respiratory syndrome virus
TFDTRSC

SEQ ID NO: 983 - protein, 35 aa, Human severe acute respiratory syndrome virus
HIGTSFCSNRNCRLRYVCCFERAAAEWYEWSYYPW

SEQ ID NO: 984 - protein, 5 aa, Human severe acute respiratory syndrome virus
HYFRR

SEQ ID NO: 985 - protein, 4 aa, Human severe acute respiratory syndrome virus
VYTI

SEQ ID NO: 986 - protein, 9 aa, Human severe acute respiratory syndrome virus
TMLWCYLPR

SEQ ID NO: 987 - protein, 5 aa, Human severe acute respiratory syndrome virus
VQENC

SEQ ID NO: 988 - protein, 52 aa, Human severe acute respiratory syndrome virus
GHSSLDAFNFLDITIDSCSKYTVVTVFLCLRECFLAIYSWYYGNCCMCYAAC

SEQ ID NO: 989 - protein, 18 aa, Human severe acute respiratory syndrome virus
ARILVLVSVTFSCNSCLL

SEQ ID NO: 990 - protein, 6 aa, Human severe acute respiratory syndrome virus
YGLHAC

SEQ ID NO: 991 - protein, 9 aa, Human severe acute respiratory syndrome virus
LGDAYHDMA

SEQ ID NO: 992 - protein, 4 aa, Human severe acute respiratory syndrome virus
LVWL

SEQ ID NO: 993 - protein, 21 aa, Human severe acute respiratory syndrome virus
GLCYVCFSFSFAYSHDSSHCL

SEQ ID NO: 994 - protein, 18 aa, Human severe acute respiratory syndrome virus
TCLDTDECHYTCLQSLLW

SEQ ID NO: 995 - protein, 17 aa, Human severe acute respiratory syndrome virus
CFRSSYFHVGLSYFCNL

SEQ ID NO: 996 - protein, 12 aa, Human severe acute respiratory syndrome virus
LFWCRYDYHVFS

SEQ ID NO: 997 - protein, 7 aa, Human severe acute respiratory syndrome virus
SYSVCVC

SEQ ID NO: 998 - protein, 47 aa, Human severe acute respiratory syndrome virus
VLPIVIYYWQHLTVYHACLLFLRLLLLLLLWPFLFTQPLLQAYSWCL

SEQ ID NO: 999 - protein, 8 aa, Human severe acute respiratory syndrome virus
LLGLYTRI

SEQ ID NO: 1000 - protein, 10 aa, Human severe acute respiratory syndrome virus
VYELPGAFAS

SEQ ID NO: 1001 - protein, 4 aa, Human severe acute respiratory syndrome virus
CFQA

SEQ ID NO: 1002 - protein, 6 aa, Human severe acute respiratory syndrome virus
VVGYWR

SEQ ID NO: 1003 - protein, 10 aa, Human severe acute respiratory syndrome virus
TMYQGCYCTV

SEQ ID NO: 1004 - protein, 15 aa, Human severe acute respiratory syndrome virus
RKVHICGTALGSSTT

SEQ ID NO: 1005 - protein, 5 aa, Human severe acute respiratory syndrome virus
SRVIF

SEQ ID NO: 1006 - protein, 10 aa, Human severe acute respiratory syndrome virus
IVGTMCTTPQ

SEQ ID NO: 1007 - protein, 8 aa, Human severe acute respiratory syndrome virus
YSSCKRHN

SEQ ID NO: 1008 - protein, 21 aa, Human severe acute respiratory syndrome virus
SFREDGFSFVCFAIHAGCCRH

SEQ ID NO: 1009 - protein, 7 aa, Human severe acute respiratory syndrome virus
VVRGNAR

SEQ ID NO: 1010 - protein, 11 aa, Human severe acute respiratory syndrome virus
PCYSSGYCFRI

SEQ ID NO: 1011 - protein, 15 aa, Human severe acute respiratory syndrome virus
FFTIICRLCHCPGGL

SEQ ID NO: 1012 - protein, 4 aa, Human severe acute respiratory syndrome virus
AGCS

SEQ ID NO: 1013 - protein, 13 aa, Human severe acute respiratory syndrome virus
SRSQKVKEIFECG

SEQ ID NO: 1014 - protein, 24 aa, Human severe acute respiratory syndrome virus
CCHATQVGKDGRSGYDPNVQTGKI

SEQ ID NO: 1015 - protein, 7 aa, Human severe acute respiratory syndrome virus
GQEGKSN

SEQ ID NO: 1016 - protein, 10 aa, Human severe acute respiratory syndrome virus
CYANNALHYA

SEQ ID NO: 1017 - protein, 7 aa, Human severe acute respiratory syndrome virus
QHYQQCA

SEQ ID NO: 1018 - protein, 21 aa, Human severe acute respiratory syndrome virus
WLCSTQHHTIDYSSQTHGCCP

SEQ ID NO: 1019 - protein, 8 aa, Human severe acute respiratory syndrome virus
LWYLQEHL

SEQ ID NO: 1020 - protein, 15 aa, Human severe acute respiratory syndrome virus
HLYICICTLGNPASC

SEQ ID NO: 1021 - protein, 5 aa, Human severe acute respiratory syndrome virus
QDCST

SEQ ID NO: 1022 - protein, 22 aa, Human severe acute respiratory syndrome virus
HGQFTKFGLASYCYSSKSQLSC

SEQ ID NO: 1023 - protein, 21 aa, Human severe acute respiratory syndrome virus
TESSSTTTDVLCGWYHTNSLY

SEQ ID NO: 1024 - protein, 6 aa, Human severe acute respiratory syndrome virus
QCTCLL

SEQ ID NO: 1025 - protein, 5 aa, Human severe acute respiratory syndrome virus
QFEGR

SEQ ID NO: 1026 - protein, 15 aa, Human severe acute respiratory syndrome virus
VCAGITIRPPRSQMG

SEQ ID NO: 1027 - protein, 13 aa, Human severe acute respiratory syndrome virus
WYRYNLHRTGTTL

SEQ ID NO: 1028 - protein, 9 aa, Human severe acute respiratory syndrome virus
VCYRHTKRA

SEQ ID NO: 1029 - protein, 14 aa, Human severe acute respiratory syndrome virus
SEILVLHQRLKQPK

SEQ ID NO: 1030 - protein, 38 aa, Human severe acute respiratory syndrome virus
RYGAGQFSCYSTSSGWKCYRSTCQFNCAFLLCFCSRPC

SEQ ID NO: 1031 - protein, 33 aa, Human severe acute respiratory syndrome virus
GLPSKWRTTNHQLCEDVVYTHWYRTGNYCNTRS

SEQ ID NO: 1032 - protein, 15 aa, Human severe acute respiratory syndrome virus
HGPRVLWWCFMLSVL

SEQ ID NO: 1033 - protein, 4 aa, Human severe acute respiratory syndrome virus
PSKS

SEQ ID NO: 1034 - protein, 9 aa, Human severe acute respiratory syndrome virus
VRPNTYHLC

SEQ ID NO: 1035 - protein, 6 aa, Human severe acute respiratory syndrome virus
PSGFYT

SEQ ID NO: 1036 - protein, 15 aa, Human severe acute respiratory syndrome virus
KHSLYRLRNVERLWL

SEQ ID NO: 1037 - protein, 2712 aa, Human severe acute respiratory syndrome virus
PTPRTLDAVCGCINVFKRVCGVSAARLTPCGTGTSTDVVYRAFDIYNEKVAGFAKFLKTNCCRFQEKDEEGNLLDSYFVVKRHTMSNYQHEETIYNLVKDCPAVAVHDFFKFRVDGDMVPHISRQRLTKYTMADLVYALRHFDEGNCDTLKEILVTYNCCDDDYFNKKDWYDFVENPDILRVYANLGERVRQSLLKTVQFCDAMRDAGIVGVLTLDNQDLNGNWYDFGDFVQVAPGCGVPIVDSYYSLLMPILTLTRALAAESHMDADLAKPLIKWDLLKYDFTEERLCLFDRYFKYWDQTYHPNCINCLDDRCILHCANFNVLFSTVFPPTSFGPLVRKIFVDGVPFVVSTGYHFRELGVVHNQDVNLHSSRLSFKELLVYAADPAMHAASGNLLLDKRTTCFSVAALTNNVAFQTVKPGNFNKDFYDFAVSKGFFKEGSSVELKHFFFAQDGNAAISDYDYYRYNLPTMCDIRQLLFVVEVVDKYFDCYDGGCINANQVIVNNLDKSAGFPFNKWGKARLYYDSMSYEDQDALFAYTKRNVIPTITQMNLKYAISAKNRARTVAGVSICSTMTNRQFHQKLLKSIAATRGATVVIGTSKFYGGWHNMLKTVYSDVETPHLMGWDYPKCDRAMPNMLRIMASLVLARKHNTCCNLSHRFYRLANECAQVLSEMVMCGGSLYVKPGGTSSGDATTAYANSVFNICQAVTANVNALLSTDGNKIADKYVRNLQHRLYECLYRNRDVDHEFVDEFYAYLRKHFSMMILSDDAVVCYNSNYAAQGLVASIKNFKAVLYYQNNVFMSEAKCWTETDLTKGPHEFCSQHTMLVKQGDDYVYLPYPDPSRILGAGCFVDDIVKTDGTLMIERFVSLAIDAYPLTKHPNQEYADVFHLYLQYIRKLHDELTGHMLDMYSVMLTNDNTSRYWEPEFYEAMYTPHTVLQAVGACVLCNSQTSLRCGACIRRPFLCCKCCYDHVISTSHKLVLSVNPYVCNAPGCDVTDVTQLYLGGMSYYCKSHKPPISFPLCANGQVFGLYKNTCVGSDNVTDFNAIATCDWTNAGDYILANTCTERLKLFAAETLKATEETFKLSYGIATVREVLSDRELHLSWEVGKPRPPLNRNYVFTGYRVTKNSKVQIGEYTFEKGDYGDAVVYRGTTTYKLNVGDYFVLTSHTVMPLSAPTLVPQEHYVRITGLYPTLNISDEFSSNVANYQKVGMQKYSTLQGPPGTGKSHFAIGLALYYPSARIVYTACSHAAVDALCEKALKYLPIDKCSRIIPARARVECFDKFKVNSTLEQYVFCTVNALPETTADIVVFDEISMATNYDLSVVNARLRAKHYVYIGDPAQLPAPRTLLTKGTLEPEYFNSVCRLMKTIGPDMFLGTCRRCPAEIVDTVSALVYDNKLKAHKEKSAQCFKMFYKGVITHDVSSAINRPQIGVVREFLTRNPAWRKAVFISPYNSQNAVASKILGLPTQTVDSSQGSEYDYVIFTQTTETAHSCNVNRFNVAITRAKIGILCIMSDRDLYDKLQFTSLEIPRRNVATLQAENVTGLFKDCSKIITGLHPTQAPTHLSVDIKFKTEGLCVDIPGIPKDMTYRRLISMMGFKMNYQVNGYPNMFITREEAIRHVRAWIGFDVEGCHATRDAVGTNLPLQLGFSTGVNLVAVPTGYVDTENNTEFTRVNAKPPPGDQFKHLIPLMYKGLPWNVVRIKIVQMLSDTLKGLSDRVVFVLWAHGFELTSMKYFVKIGPERTCCLCDKRATCFSTSSDTYACWNHSVGFDYVYNPFMIDVQQWGFTGNLQSNHDQHCQVHGNAHVASCDAIMTRCLAVHECFVKRVDWSVEYPIIGDELRVNSACRKVQHMVVKSALLADKFPVLHDIGNPKAIKCVPQAEVEWKFYDAQPCSDKAYKIEELFYSYATHHDKFTDGVCLFWNCNVDRYPANAIVCRFDTRVLSNLNLPGCDGGSLYVNKHAFHTPAFDKSAFTNLKQLPFFYYSDSPCESHGKQVVSDIDYVPLKSATCITRCNLGGAVCRHHANEYRQYLDAYNMMISAGFSLWIYKQFDTYNLWNTFTRLQSLENVAYNVVNKGHFDGHAGEAPVSIINNAVYTKVDGIDVEIFENKTTLPVNVAFELWAKRNIKPVPEIKILNNLGVDIAANTVIWDYKREAPAHVSTIGVCTMTDIAKKPTESACSSLTVLFDGRVEGQVDLFRNARNGVLITEGSVKGLTPSKGPAQASVNGVTLIGESVKTQFNYFKKVDGIIQQLPETYFTQSRDLEDFKPRSQMETDFLELAMDEFIQRYKLEGYAFEHIVYGDFSHGQLGGLHLMIGLAKRSQDSPLKLEDFIPMDSTVKNYFITDAQTGSSKCVCSVIDLLLDDFVEIIKSQDLSVISKVVKVTIDYAEISFMLWCKDGHVETFYPKLQASQAWQPGVAMPNLYKMQRMLLEKCDLQNYGENAVIPKGIMMNVAKYTQLCQYLNTLTLAVPYNMRVIHFGAGSDKGVAPGTAVLRQWLPTGTLLVDSDLNDFVSDADSTLIGDCATVHTANKWDLIISDMYDPRTKHVTKENDSKEGFFTYLCGFIKQKLALGGSIAVKITEHSWNADLYKLMGHFSWWTAFVTNVNASSSEAFLIGANYLGKPKEQIDGYTMHANYIFWRNTNPIQLSSYSLFDMSKFPLKLRGTAVMSLKENQINDMIYSLLEKGRLIIRENNRVVVSSDILVNN

SEQ ID NO: 1038 - protein, 1257 aa, Human severe acute respiratory syndrome virus
TNMFIFLLFLTLTSGSDLDRCTTFDDVQAPNYTQHTSSMRGVYYPDEIFRSDTLYLTQDLFLPFYSNVTGFHTINHTFDNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDTWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 1039 - protein, 7 aa, Human severe acute respiratory syndrome virus
TNLWICL

SEQ ID NO: 1040 - protein, 12 aa, Human severe acute respiratory syndrome virus
DFLLLDQLLHSQ

SEQ ID NO: 1041 - protein, 43 aa, Human severe acute respiratory syndrome virus
KLTMLLLQVLFMLQQRYRYKPHSLSDGLLLALHFLLFFRALPK

SEQ ID NO: 1042 - protein, 8 aa, Human severe acute respiratory syndrome virus
LRSIKDGS

SEQ ID NO: 1043 - protein, 39 aa, Human severe acute respiratory syndrome virus
PFIRASSSFAIYCCYLLPSIHIFCLSLQVWRRNFCTSMP

SEQ ID NO: 1044 - protein, 13 aa, Human severe acute respiratory syndrome virus
YIFYNASTHVELL

SEQ ID NO: 1045 - protein, 169 aa, Human severe acute respiratory syndrome virus
DVGFVGSANPRTHYFMMPTTLFAGTHITMTTVYHITVSQIQLSLLKVTAFQHQNSKKTTKLVVILRIGTQVLKTMSLYMAISPKFTTSLSLHKLLQTLVLKMLHSSSLTSLLKTHRMCKYTQSTALQELLIQQWIQFMMSRRRLLACLCKHKKVSTNLCTHSFRKKQVR

SEQ ID NO: 1046 - protein, 14 aa, Human severe acute respiratory syndrome virus
LIAYFFFLLSWYSC

SEQ ID NO: 1047 - protein, 17 aa, Human severe acute respiratory syndrome virus
PSLLRFDCVRTAAILLT

SEQ ID NO: 1048 - protein, 12 aa, Human severe acute respiratory syndrome virus
NQRFTSTRVLKI

SEQ ID NO: 1049 - protein, 37 aa, Human severe acute respiratory syndrome virus
TLLKEFLIFWSKRTNYYYYSVWNFNIAYHGRQRYYYR

SEQ ID NO: 1050 - protein, 26 aa, Human severe acute respiratory syndrome virus
TTPGTMEPSNRFPIPSLDYVTTICLF

SEQ ID NO: 1051 - protein, 32 aa, Human severe acute respiratory syndrome virus
SEQVFVHNKACFPLALVASNTCLFCACCCLQN

SEQ ID NO: 1052 - protein, 19 aa, Human severe acute respiratory syndrome virus
LGDWRDCDCNGLYCRLDVA

SEQ ID NO: 1053 - protein, 42 aa, Human severe acute respiratory syndrome virus
LLRCFLQAVCSYPLNVVIQPRNKHSSQCASPGDNCDQTAHGK

SEQ ID NO: 1054 - protein, 22 aa, Human severe acute respiratory syndrome virus
TCHWCCDHSWSLANGRTLPRAL

SEQ ID NO: 1055 - protein, 27 aa, Human severe acute respiratory syndrome virus
GPAKRDHCGYITNAFLLQIRSVAACRH

SEQ ID NO: 1056 - protein, 14 aa, Human severe acute respiratory syndrome virus
FRFCCIQPLPYWKL

SEQ ID NO: 1057 - protein, 7 aa, Human severe acute respiratory syndrome virus
IKYRPRR

SEQ ID NO: 1058 - protein, 24 aa, Human severe acute respiratory syndrome virus
QRQYCFASTVSDNRCFILLTSRLQ

SEQ ID NO: 1059 - protein, 12 aa, Human severe acute respiratory syndrome virus
GLSGLLFGILTL

SEQ ID NO: 1060 - protein, 6 aa, Human severe acute respiratory syndrome virus
DNYLSL

SEQ ID NO: 1061 - protein, 7 aa, Human severe acute respiratory syndrome virus
LRRIIRS

SEQ ID NO: 1062 - protein, 7 aa, Human severe acute respiratory syndrome virus
MMKNLWS

SEQ ID NO: 1063 - protein, 128 aa, Human severe acute respiratory syndrome virus
IIHKTNMKIILFLTLIVFTSCELYHYQECVRGTTVLLKEPCPSGTYEGNSPFHPLADNKFALTCTSTHFAFACADGTRHTYQLRARSVSPKLFIRQEEVQQELYSPLFLIVAALVFLILCFTIKRKTE

SEQ ID NO: 1064 - protein, 4 aa, Human severe acute respiratory syndrome virus
MSSL

SEQ ID NO: 1065 - protein, 7 aa, Human severe acute respiratory syndrome virus
LTSICAF

SEQ ID NO: 1066 - protein, 7 aa, Human severe acute respiratory syndrome virus
PFCYSLF

SEQ ID NO: 1067 - protein, 13 aa, Human severe acute respiratory syndrome virus
CLLYFGFHSKSRI

SEQ ID NO: 1068 - protein, 10 aa, Human severe acute respiratory syndrome virus
KNLVPKSKRT

SEQ ID NO: 1069 - protein, 5 aa, Human severe acute respiratory syndrome virus
NFSLF

SEQ ID NO: 1070 - protein, 11 aa, Human severe acute respiratory syndrome virus
LVFLYAVAYAL

SEQ ID NO: 1071 - protein, 93 aa, Human severe acute respiratory syndrome virus
YSAVHLINLMCLKILVRYNTRGNTYSTAWLCALGKVLPFHRWHTMVQTCTPNVTINCQDPAGGALIARCWYLHEGHQTAAFRDVLVVLNKRTN

SEQ ID NO: 1072 - protein, 7 aa, Human severe acute respiratory syndrome virus
WTPIKPT

SEQ ID NO: 1073 - protein, 13 aa, Human severe acute respiratory syndrome virus
CPPHYIWWTHRFN

SEQ ID NO: 1074 - protein, 20 aa, Human severe acute respiratory syndrome virus
PEWRTQWGKAKTAPTPRFTQ

SEQ ID NO: 1075 - protein, 16 aa, Human severe acute respiratory syndrome virus
YCVLVHSSHSAWQGGT

SEQ ID NO: 1076 - protein, 12 aa, Human severe acute respiratory syndrome virus
IPSRPGRSNQHQ

SEQ ID NO: 1077 - protein, 15 aa, Human severe acute respiratory syndrome virus
PNWLLPKSYPTSSWW

SEQ ID NO: 1078 - protein, 27 aa, Human severe acute respiratory syndrome virus
RQNERAQPQMVLLLPRNWPRSFTSLRR

SEQ ID NO: 1079 - protein, 9 aa, Human severe acute respiratory syndrome virus
QRRHRMGCN

SEQ ID NO: 1080 - protein, 15 aa, Human severe acute respiratory syndrome virus
GSLEYTQRPHWHPQS

SEQ ID NO: 1081 - protein, 36 aa, Human severe acute respiratory syndrome virus
QCCHRATTSSRNNIAKRLLRRGKQRRQSSLFSLLIT

SEQ ID NO: 1082 - protein, 9 aa, Human severe acute respiratory syndrome virus
FKKFNSWQQ

SEQ ID NO: 1083 - protein, 8 aa, Human severe acute respiratory syndrome virus
GKFSCSNG

SEQ ID NO: 1084 - protein, 14 aa, Human severe acute respiratory syndrome virus
NCPRAIAARQIEPA

SEQ ID NO: 1085 - protein, 5 aa, Human severe acute respiratory syndrome virus
EQSFW

SEQ ID NO: 1086 - protein, 10 aa, Human severe acute respiratory syndrome virus
RPTTTRPNCH

SEQ ID NO: 1087 - protein, 4 aa, Human severe acute respiratory syndrome virus
EICC

SEQ ID NO: 1088 - protein, 40 aa, Human severe acute respiratory syndrome virus
KASPKTYCHKTVQRHSSIWETWSRTNPRKFRGPRPNQTRN

SEQ ID NO: 1089 - protein, 40 aa, Human severe acute respiratory syndrome virus
LQTLAANCTICSKCLCILWNVTHWHGSHTFGNMADLSWSH

SEQ ID NO: 1090 - protein, 16 aa, Human severe acute respiratory syndrome virus
QRSTIQRQRHTAEQAH

SEQ ID NO: 1091 - protein, 10 aa, Human severe acute respiratory syndrome virus
RIQNIPTNRA

SEQ ID NO: 1092 - protein, 7 aa, Human severe acute respiratory syndrome virus
KGQKEKD

SEQ ID NO: 1093 - protein, 20 aa, Human severe acute respiratory syndrome virus
SSAFAAETKEAAHCDSSSCG

SEQ ID NO: 1094 - protein, 14 aa, Human severe acute respiratory syndrome virus
FLQTTSKFHEWSFC

SEQ ID NO: 1095 - protein, 39 aa, Human severe acute respiratory syndrome virus
FNSGINTHDDHTRQMGYVNVFAIPFTIHSLLLCRMNSRN

SEQ ID NO: 1096 - protein, 12 aa, Human severe acute respiratory syndrome virus
TAQVGLVNFNLT

SEQ ID NO: 1097 - protein, 6 aa, Human severe acute respiratory syndrome virus
QSLINV

SEQ ID NO: 1098 - protein, 21 aa, Human severe acute respiratory syndrome virus
GGLERATTFSSRPRGVRSRVQ

SEQ ID NO: 1099 - protein, 12 aa, Human severe acute respiratory syndrome virus
IMLGRAAYMEEP

SEQ ID NO: 1100 - protein, 20 aa, Human severe acute respiratory syndrome virus
CVKLILVVLSPCDFNSFLGE

SEQ ID NO: 1101 - protein, 8 aa, Human severe acute respiratory syndrome virus
QKKKKKKK

SEQ ID NO: 1102 - DNA, 29736 bp, Human severe acute respiratory syndrome virus
  CDS (1)..(29736)
ttttttttttttttttttttttttgtcattctcctaagaagctattaaaatcacatggggatagcactactaaaattaattttacacattagggctcttccatataggcagctctccctagcattattcactgtaccctcgatcgtactccgcgtggcctcgatgaaaatgtggtggctctttcaagtcctccctaatgttacacattgattaaagattgctatgtgagattaaagttaactaaacctacttgtgctgtttagttacgagaattcattctgcacaagagtagactatgtatcgtaaacggaattgcgaaaacgtttacatagcccatctgccttgtgtggtcatcatgagtgtttatgcctgagttgaatcagcagaagctccactcatggaattttgaagttgtctggagaaatcatccatgtcagccgcaggaagaagagtcacagtgggctgcttcttttgtctctgcggcaaaggctgagcttcatcagtctttttctttttgtcctttttaggctctgttggtgggaatgttttgtatgcgtcaatgtgcttgttcagcagtatgacgttgtctttgaattgtggatctttgtcatccaatttaatggctccatgataagtcagccatgttcccgaaggtgtgacttccatgccaatgcgtgacattccaaagaatgcagaggcacttggagcaaattgtgcaatttgcggccaatgtttgtaatcagttccttgtctgattaggtcttggtccccgaaatttccttgggtttgttctggaccacgtctcccaaatgcttgagtgacgttgtactgttttgtggcagtacgtttttggcgaggctttttagatgcctcagcagcagatttcttagtgacagtttggccttgttgttgttggcctttaccagaaactttgctctcaagctggttcaatctgtctagcagcaatagcgcgagggcagtttcaccacctccgctagccattcgagcaggagaatttcccctactgctgccaggagttgaatttcttgaattaccgcgactacgtgatgaggagcgagaagaggcttgactgccgcctctgcttccctctgcgtagaagccttttggcaatgttgttccttgaggaagttgtagcacggtggcagcattgttattaggattgcgggtgccaatgtggtctttgggtgtattcaaggctccctcagttgcaacccatacgatgccttctttgttagcgccgtagggaagtgaagcttctgggccagttcctaggtaatagaagtaccatctggggctgagctctttcattttgccgtcaccaccacgaactcgtcgggtagctcttcggtagtagccaatttggtcatctggaccactattggtgttgattggaacgccctggcctcgagggaatctaagttcctccttgccatgctgagtgagagctgtgaaccaagacgcagtattattgggtaaaccttggggtcggcgctgttttggccttgccccattgcgtcctccattctggttattgtcagttgaatctgtgggtccaccaaatgtaatgcggggggcactacgttggtttgattggggtccattatcagacattttaatttgttcgtttatttaaaacaacaagtacgtctctaaatgcagcagtttggtgaccttcatgaaggtaccaacacctagctataagcgcaccaccagctggatcttgacagttgatagtaacattaggtgtgcatgtttgaaccatagtgtgccatctatgaaaaggtaaaacctttcctagagcacaaagccaagcagtgctataagtattacccctagtgttgtaccttacaaggatcttcaagcacatgaggtttattagatgcacagcgctgtactacagtgcgtatgcaactgcatagagaaatacaagtcaaaacaatgagaagtttcatgttcgtttagactttggtacaaggttcttctagatcctggatttcgagtgaaaaccaaaatataataagcattattaaaacaaggaatagcagaaaggctaaaaagcacaaatagaagtcaattaaagtgagctcattcattctgtctttctcttaatggtgaagcaaagtattaaaaatactagagcagcaacaatgagaaaaagtggcgagtagagctcttgttgaacctcctcttgtctgatgaaaagttttggtgaaactgatcttgcacgcagctgataggtatgtcgagtaccgtcagcacaagcaaaagcaaagtgtgtgctagtgcaagttagtgcaaatttattgtcagcaagagggtgaaatggtgaattgccctcgtatgttcctgatgggcaaggttcttttagtagtacagtcgtacctctaacacactcctgatagtgatatagctcgcaagatgtaaatacaatcaatgtcaggaagagaataattttcatgttcgttttatggataatctaactccataggttcttcatcatctaactccgaataattcttcttagttagaggcttaaataattgtctcactattgaacttattataacgtcaagattccaaatagcaatcctgaaagtcctcataatgataatcaatatctctgctattgtaacctggaagtcaacaagatgaaacatctgttgtcacttactgtactagcaaagcaatattgtcgttgctaccggcgtggtctgtatttaatttatagtttccaatacggtagcggttgtatgcagcaaaacctgaatcagtgcctacacgctgcgacgctcctaatttgtaataagaaagcgttcgtgatgtagccacagtgatctcttttggcaggtccttaatgtcacagcgccctagggagtgtccggccattcgcaagtgaccacgaatgatcacagcaccaatgacaagttcactttccatgagcggtctggtcacaattgtcccccggagaggcacattgagaagaatgtttgtttctgggttgaatgaccacattgagcgggtacgagcaaacagcctgaaggaagcaacgaagtagctaagccacatcaagcctacaatacaagccattgcaatcgcaatcccgccagtcacccaattaattctgtagacagcagcaagcacaaaacaagcaagtgttactggccacaagagccagaggaaaacaagctttattatgtacaaaaacctgttccgattagaataggcaaattgtagtaacataatccaggctaggaataggaaacctattactaggttccattgttccaggagttgtttaagctcctcaacggtaatagtaccgttgtctgccatgataagcaatgttaaagttccaaacagaataataataatagttagttcgtttagaccagaagatcaggaactccttcagaagagttcagatttttaacacgcgagtagacgtaaaccgttggttttactaaactcacgttaacaatattgcagcagtacgcacacaatcgaagcgcagtaaggatggctagtgtgactagcaagaataccacgaaagcaagaaaaagaagtacgctattaactattaacgtacctgtttcttccgaaacgaatgagtacataagttcgtactcactttcttgtgcttacaaaggcacgctagtagtcgtcgtcggctcatcataaattggatccattgctggattagcaactcctgaagagccgtcgattgtgtgtatttgcacattcggtgggtctttaacaagcttgttaaagatgaagaatgtagcattttcaataccagtgtctgtagtaatttgtgtagactcaagctggtagtaaacttcggtgaaatagccatgtacaacgacatagtctttaacacctgagtgcctatcctcagaataaccaccaatttggtagtcttctttgagttttggtgttgaaatgccgtcaccttcagtaacgacaattgtatctgtgacactgttatatggtatacagtagtcatagttatgtgtgtgccagcaaacaaagtagttggcatcataaagtaatgggttcttggatttgcacttccaacaaagccaacatctcataataattctacatgcgttgatgcattgtagaaaatatatcaaggcatagaggtacaaaaattgcgcctccatacctgcagcgacaagcaaaagatgtgaatagatggtaacaaatagcagcagtaaattgcaaatgaactggaagcccttataaagggctagctgccatcttttattgagcgcaattattttggtagcgctctgaaaaacagcaagaaatgcaacgccaataacaagccatccgaaagggagtgaggcttgtagcggtatcgttgctgtagcatgaacagtacttgcaggagaagcattgtcaatttttactggctgtgcagtaattgatccaagagtaaaaaatctcataaacaaatccataagttcgtttatgtgtaatgtaatttgacacccttgagaactggctcagagtcatcctcatcaaacttgcagcaagaaccacaagagcatgcacccttgaggcaactgcaacaactagtcatgcaacaaagcaagattgtaaccatgacgatggcaattagtccagcaatgaagccgagccaaacataccaaggccatttaatatattgctcatattttcccaattcttgaaggtcaatgagtgattcatttaaatttttagcgacctcattgaggcggtcaatttctttttgaatgttgacgacagaagcgttaatgcctgaaatgtcgccaagatcaacatctggtgatgtatgatttttgaagtacttgtccagctcttctttgaatgagtcaagctcaggttgcagaggatcataaactgtgttgttaatgatgccaataacgacatcacaatttcctgagacaaatgtattgtctgtagtaattatttgtggagaaaagaagttcctctgtgtaataaaccaagaagtgccattaaacacaaaaacaccttcacgagggaagtatgctttgccttcatgacaaattgctggcgctgtggtgaagttcctctcctgggatggcacatacgtgacatgtaggaagacaacaccatgcggggctgcttgtgggaaggacataaggtggtagccctttccacaaaagtcaactctttttgattgtccaagaacacactcagacattttagtagcagcaagattagcagaagccctgatttcagcagccctgattagttgttgtgttacataggtttgaaggctttgaagtctgcctgtaattaacctgtcaatttgtacctccgcctcgactttatcaagtcgcgaaaggatatcatttagcacacttgaaattgcaccaaaattagagctaagttgtttaacaagtgtgtttaatgcttgagcattctggttaacaacgtcttgcagcttgcccaatgcagttgatgttgttgtaagtgattcttgaatttgactaatcgccttgttaaattggttggcgatttgtttttggttctcatagagaacattttgggtaactccaatgccattgaacctatatgccatttgcatagcaaaaggtatttgaagagcagcgccagcaccaaatgtccatccagcagtggcagtaccactaactagagcagcagtgtaggcagcaatcatatcatcagtgagcagaggtggcaacactgtaagtccattgaacttctgcgcacaaatgagatctctagcattaatatcacctaggcattcgccatattgcttcatgaagccagcatcagcgagtgtcaccttattaaagagcaagtcctcaataaaagacctcttagttggctttagagggtcaggtaatatttgtgaaaaattaaaaccaccaaaatatttcaaagttggggttttgtacatttgtttgacttgagcgaacacttcacgtgtgttgcgatcctgttcagcagcaatacctgagagtgcacgatttagttgtgtgcaaaagctaccatattggagaagcaaattagcacattcagtagaatctccgcagatgtacatattacaatctacggaggttttagccatagaaacaggcattacttctgtagtaatgctaattgaaaagttagtaggtatagcaatggtgttattagagtaagcaattgaactatcagcacctaaagacatagtataagccacaatagatttttggctagtactacgtaataaagaaactgtatggtaactagcacaaatgccagctccaataggaatgtcgcactcataagaagtgtcgacatgctcagctcctataagacagcctgcttgagtctggaatacattgtttccagtagaatatatgcgccaagctggtgtgagttgatctgcatgaattgctgtagaaacatcagtgcagttaacatcttgatatagaacagcaacttcagatgaagcatttgttccaggtgtaattacacttacacccccaaaagagcaaggtgaaatgtctaatatttcagatgttttaggatctcgaacggaatcagtgaaatcagaaacatcacggccaaattgttgaaatggttgaaatctctttgaagaaggagttaacacaccagtaccagtgagtccattaaaattaaaattgacacactggttcttaataaggtcagtggataattttggtccacaaaccgtggccggtgcatttaaaagttcaaaagaaagtactacaactctgtaaggttggtagccaatgccagtagtggtgtaaaaaccataatcatttaatggccaataacaattaagagcaggtggggtgcaaggtttgccatcaggggagaaaggcacattagatatgtctctctcaaagggcctaagcttgccatgtctaagatacctatatttataattataattaccagttgaagtagcatcaatgttcctagtattccaagcaaggacacaacccatgaaatcatctggcaatttataattataatcagcaataacaccagtttgtcctggcgctatttgtcttacatcatctcccttgactacaaaagaatctgcatagacattggagaagcaaagatcattcaacttagtggcagaaacgccatagcacttaaaggttgaaaaaaatgttgagttgtagagcacagagtaatcagcaacacaattagaaattttttttctctcccatgcatagacagaagggaatttagtagcattaaaaacctctccaaaaggacacaagtttgtaatattagggaatctcacaacatctcctgagggaacaaccctgaaattagaggtctggtaaattcctttgtcaatctcaaagctcttaacagagcatttgagttcagcaagtggattttgagaacaatcaacagcatctgtgattgtaccattttcatcatacttgagcataaatgtagttggctttaaatagccaacaaaataggctgcagctgacgtgccccaagtgtcttgagcaggtgaaaaggctgtaagaatggctctaaaatttgtaatgttaataccaagaggcaacttaaaaataggtttcaaagtgttaaaaccagaaggtagatcacgaactacatctataggttgatagcccttataaacatagagaaacccatctttatttttaaacacaaactctcgtaagtgtttaaaattacctgacttttctgaaacatcaagcgaaaaggcatcagatatgtactcgaaagtgcaattaaatgcattatcgaatatcatagtatgtgtctgtgtacccatgggtttagaaacagcaaagaaagggttgtcacacaattcaaagttacatgctcgtataacaacattagtagaattgttaataataatcaccgactgtgacttgttgttcatggtagaaccaaaaacccaaccacggacaacatttgatttctctgtggcagcaaaataaataccatccttaaaaggtatgacagggttgtcaaacgtatgattaatagtatgaaaccctgtaacattagaataaaatggaagaaataaatcctgagttaaataaagagtgtctgatctaaaaatttcatcaggatagtaaacccccctcatagatgaagtatgttgagtgtaattaggagcttgaacatcatcaaaagtggtgcaccggtcaaggtcactaccactagtgagagtaagaaataataagaaaataaacatgttcgtttagttgttaacaagaatatcacttgaaaccacaactctgttgttttctctaatgataagcctacctttttccagaagagaataaatcatatcattgatttgattctccttaagagacattacagcagttcctcttaatttaagaggaaatttgctcatgtcaaagagtgaataggaagacaactggataggatttgtgttcctccagaaaatgtagttagcatgcatggtatagccatcaatttgttccttcggcttgccaagatagttagccccaattaaaaatgcttccgatgatgatgcatttacatttgtaacaaaagctgtccaccatgagaaatggcccataagcttgtaaaggtcagcattccaagaatgctctgttatctttacagctatagaaccacccagggctagtttttgctttataaatccacacagataagtgaaaaacccttctttagagtcattctcttttgtcacatgtttggtcctagggtcatacatatcgctaataataaggtcccatttattagccgtatgtactgttgcacagtctccaattaaagtagaatctgcgtcggagacgaagtcattaagatctgaatcgacaagtagtgtgccagttggcaaccattgtctgagcacagctgtacctggtgcaactcctttatcagagccagcaccaaagtgaataactctcatgttgtagggtacagctaaagtaagtgtatttaagtattgacacagttgagtatactttgcgacattcatcattattccttttggtataacagcattttcaccataattctgaaggtcacacttttcaagaagcattctttgcatcttgtacaagttaggcatcgcaacacctggttgccacgcttgacttgcttgtagttttgggtagaaggtttcaacatgtccatccttacaccaaagcatgaatgaaatttcagcatagtcaattgtaaccttgaccacttttgaaatcactgacaaatcttgtgactttattatctcgacaaagtcatcaagtaaaagatcaatcacagaacacacacattttgatgaacctgtttgcgcatctgttatgaagtaatttttcactgtgctgtccatagggataaaatcctctaatttaagtggtgaatcttgtgagcgcttggctaagcctatcattaaatgaagaccgccaagttgtccatgactgaaatctccataaacgatgtgttcgaaggcatagccctcgagcttatatcgctgtatgaattcatccatagcgagctcgagaaagtcagtttccatttgtgatctgggcttaaaatcctctaagtctctgctctgagtaaagtaggtttcaggcaactgttgaataatgccgtctactttcttaaagtagttaaactgtgtttttactgattctccaattaatgtgactccattgacgctagcttgtgctggtccctttgaaggtgttagacctttgactgaaccttctgttattaaaacaccattacgggcgtttctaaaaaggtctacctgtccttccactctaccatcaaacaagacagtaagtgaagaacaagcactctcagtaggtttcttggcaatgtcagtcattgtgcagacacctattgtagatacatgtgctggggcttctcttttgtagtcccagattacagtattagcagcgatatcaacacccaaattattgagtatcttaatctctggcactggtttaatgttacgcttagcccaaagctcaaatgcaacattaacaggaagtgttgtcttattttcaaagatctccacatcaataccatctacctttgtgtaaacagcattattaatgatggaaacaggtgcttcgccggcgtgtccatcaaagtgtcctttattaacaacattataagccacattttctaaactctgtaacctggtaaatgtattccacaggttataagtatcaaattgtttgtaaatccataggctaaatccagcagaaatcatcatattatatgcatccaagtactgtcggtactcatttgcatggtgtctgcaaacagcaccacctaaattgcatcgtgtaatacacgtagcagatttgagtggaacataatcaatatccgacactacttgtttgccatgagactcacaaggactatcagaatagtaaaagaaaggcaattgctttaaattagtaaatgcacttttatcgaaagctggagtgtggaatgcatgcttattcacatacaaactaccaccatcacagcctggtaagttcaagtttgacaagactcttgtgtcaaacctacacacaattgcattggctgggtaacgatcaacgttacaattccaaaacaaacaaacaccatcagtgaatttatcgtgatgtgtagcataagaatagaagagctcctctattttgtaagctttgtcactacatggctgagcatcgtagaacttccattctacttcagcctgaggcacacacttgatagcctttggatttccaatgtcatgaagaactggaaacttatcagcaagcaatgcagacttcacaaccatgtgttgtacttttctgcaagcagaattaaccctcagttcatctcctataatagggtattcaacagaccaatcaacgcgcttaacaaagcactcatggactgctaaacatctagtcatgatagcatcacaactagccacatgtgcatttccatgtacctggcaatgttggtcatggttactctgaaggttacccgtaaagccccactgctgaacatcaatcataaatgggttatagacatagtcaaaacccacagaatgattccagcaggcataagtatctgatgaagtagaaaagcaagttgcacgtttgtcacacagacaacacgttctttcaggtccaatcttgacaaagtacttcattgatgtaagctcaaagccatgcgcccaaaggacgaacacgactctgtctgacaatcctttcagtgtatcactgagcatttgtactatcttaatacgcactacattccagggcaagcctttatacatgagtggtataagatgtttaaactggtcacctggtggaggttttgcattaactctggtgaattctgtgttattttcagtgtcaacataaccagtcggtacagctactaagttaacacctgtagaaaatcctagctggagaggtaggttagtacccacagcatctctagttgcatgacagccctctacatcaaagccaatccacgcacgaacgtgacgaatagcttcttcgcgggtgataaacatattagggtaaccattgacttggtaattcattttgaaacccatcatagagatgagtctacggtaggtcatgtcctttggtatgcctggtatgtcaacacataatccttcagtcttgaactttatatcaacgctgaggtgtgtaggtgcctgtgtaggatgaagaccagtaatgatcttactacagtccttaaaaagtccagttacattttctgcttgtaatgtagccacattgcgacgtggtatttctagacttgtaaattgcagtttgtcataaagatctctatcagacattatgcacaaaatgccaatttttgcccttgtgatagccacattgaaacggttgacattacaagagtgtgctgtttcagtagtttgtgtgaatatgacatagtcatattcagaaccctgtgatgaatcaacagtctgcgtaggcaatcctaagatttttgaagctacagcgttctgtgaattataaggtgagataaaaacagcttttctccaagcaggattgcgtgtaagaaattctcttacaacgcctatttgaggtctgttgattgcagatgaaacatcatgtgtaataacacctttgtagaacattttgaagcattgagctgacttctccttgtgtgcttttagcttattgtcataaactaaagcactcacagtgtcaacaatttcagcaggacaacggcgacaagttccaaggaacatgtctggacctattgttttcataagtctgcacactgaattaaaatattctggttctagtgtgcctttagtcagcaatgtgcggggggctggtaattgagcaggatcgccaatatagacgtagtgttttgcacgaagtctagcattgacaacactcaagtcataattagtagccatagagatttcatcaaagactacaatgtcagcagttgtttctggcaatgcatttacagtgcagaaaacatactgttctagtgttgaattcactttgaatttatcaaaacactctacgcgcgcacgcgcaggtatgattctactacatttatctatgggcaaatattttaatgccttttcacatagggcatcaacagctgcatgagagcatgccgtatacactatgcgagcagatgggtaatagagagcaagtccgatggcaaaatgactcttaccagtaccaggtggtccttggagtgtagagtacttttgcatgccgaccttttgataatttgcaacattgctagaaaactcatctgagatgttgagtgttgggtacaagccagtaattctcacatagtgctcttgtggcactagagtaggtgcactaagtggcattacagtgtgagatgtcaacacaaagtaatcaccaacattcaacttgtatgtcgtagtacctctgtacacaacagcatcaccatagtcacctttttcaaaggtgtactctccaatctgtactttactatttttagttacacggtaaccagtaaagacatagtttctgttcaatggtggtctaggttttccaacctcccatgaaagatgcaattctctgtcagagagtacttcgcgtacagtggcaataccatatgacagcttaaatgtttcctcagtggctttgagcgtttctgctgcgaaaagcttgagtctctcagtacaagtgttggcaagtatgtaatcgccagcattagtccaatcacatgttgctatcgcattgaagtcagtgacattgtcactgcctacacatgtgtttttgtataaaccaaaaacctgaccattagcacataatggaaaactaatgggaggcttatgtgacttgcaataatagctcatacctcctagatacagttgtgtcacatcagtgacatcacaacctggggcattgcaaacatagggattaacagacaacactaatttgtgtgatgttgaaatgacatggtcatagcagcacttgcaacataggaatggtctcctaatacaggcaccgcaacgaagtgaagtctgtgaattgcacaatacacaagcacctacagcctgcaagactgtatgtggtgtgtacatagcctcataaaactcaggttcccagtaccgtgaggtgttatcattagttagcattacggaatacatgtccaacatgtggccagtaagctcatcatgtaactttctaatgtattgtaaatacaagtgaaagacatcagcatactcctgattaggatgttttgtaagtgggtaagcatcaatagccagtgacacgaacctttcaatcataagtgtaccatctgttttgacaatatcatcgacaaaacagcctgcgcctaatattcttgatggatctgggtaaggcaggtacacgtaatcatctccttgtttaactagcattgtatgctgtgagcaaaattcgtgaggtcctttagtaaggtcagtctcagtccaacattttgcctcagacatgaacacattattttgataataaagaactgccttaaagttcttaatgctagctactaaaccttgagccgcatagttactgttatagcacacaacggcatcatcagaaagaatcatcatggagaaatgtttacgcaggtaagcgtaaaactcatccacgaattcatgatcaacatccctatttctatagagacactcatagagcctgtgttgtagattgcggacatacttgtcagctatcttattaccatcagttgaaagaagtgcatttacattggctgtaacagcttgacaaatgttaaagacactattagcataagcagttgtagcatcaccggatgatgttccacctggtttaacatatagtgagccgccacacatgaccatctcacttaatacttgcgcacactcgttagctaacctgtagaaacggtgtgataagttacagcaagtgttatgtttgcgagcaagaacaagagaggccattatcctaagcatgttaggcatggctctgtcacattttggataatcccaacccataaggtgtggagtttctacatcactgtaaacagtttttaacatattatgccagccaccgtaaaacttgcttgttccaattaccacagtagctcctctagtggcggctattgacttcaataatttctgatgaaactgtctatttgtcatagtactacagatagagacaccagctacggtgcgagctctattctttgcactaatggcatacttaagattcatttgagttatagtagggatgacattacgcttagtatacgcgaaaagtgcatcttgatcctcataactcattgagtcataataaagtctagccttaccccatttattaaatgggaaaccagctgatttatccagattgttaacgattacttggttggcattaatacagccaccatcgtaacaatcaaagtatttatcaacaacttcaactacgaataggagttgtctgatatcacacattgttggcagattataacgataatagtcataatcactgatagcagcgttgccatcctgagcaaagaagaagtgttttagttcaacagaacttccttccttaaagaaacctttagacacagcaaagtcataaaagtctttattaaaattaccgggtttgacagtttgaaaagcaacattgtttgttagtgcagctactgaaaagcatgtagtgcgtttatctagcaataaattgccagaagctgcatgcatagctggatcagcagcatacactaaaagttccttgaaactgagacgcgagctatgtaagtttacatcctgattatgtacgactcctaactcacgaaaatggtatccagttgaaacaacaaaaggaacaccatctacaaatatttttcttactagtggtccaaaacttgtaggtggaaacacagtagaaaataacacattaaagtttgcacaatgaaggatacacctatcatccaaacagttaatacaattgggatggtatgtctggtcccaatatttaaaataacggtcgaagagacaaagtctctcttccgtaaaatcatatttcagcaaatcccacttaataagtggttttgcgagatcagcatccatatgggactcagcagccaatgccctagtcaaagtgaggatgggcatcagcaatgagtaatatgaatccacaataggaactccgcagcctggtgctacttgtacgaaatcaccgaaatcgtaccagttcccattaagatcctgattatctaatgtcagtacgcctacaatgcctgcatcacgcatagcatcgcagaattgtacagtctttaataatgattggcgtacacgctcacctaagttagcatatacgcgtaagatgtcaggattctctacgaagtcataccaatccttcttattgaaataatcatcatcacagcaattgtatgtgacgagtatttcttttaatgtatcacaattaccctcatcaaaatgacgtagagcatagactaaatcagccattgtgtatttagttagacgctgacgtgatatatgtggtaccatgtcaccatctactctaaacttgaaaaagtcatggacagcaaccgctggacaatctttaaccaagttataaatagtctcttcatgttggtagttagacatagtatgcctcttaactacaaagtaagagtctaataaattgccttcctcatccttctcctggaagcgacagcaattagtttttaggaactttgcaaaaccagcaactttttcgttgtaaatatcaaaagccctgtagacgacatcagtactagtgcctgtgccgcacggtgtaagacgggctgcacttacaccgcaaacccgtttaaaaacgttgatgcatccgcagactgcatcaagggttcgcggagttggtcacaactacagccataacctttccacattccgcagacggtacagactgtgtttctaagtgtaaaacccactgggtcattagcacaagtggtaggtatttggacgtacttacctttcaagtcacagaatcctttaggatttggatggtcaatgtggcatctacaatacagacaacatgaagcaccaccaaaggactcttggtccatgttagcttctggtgttacagtaattgcctgtcctgtaccagtgtgtgtacacaacatcttcacacagttggtgattggttgtcctccacttgctaggtaatccttatatgctttagcagggtctactgcaaaagcacagaaggaaagcacagttgaattggcaggtacttctgtagcatttccagcctgaagacgtactgtagcagctaaactgcccagcaccatacctctatttaggttgtttaagcctttgatgaagtacaagtatttcactttaggcccttttggtgtgtctgtaacaaacctacaaggtggttccagttctgtgtaaattgtacctgtaccatcactcttagggaatctagcccatttgagatcttggtggtctgatagtaatgccagcacaaacctacctcccttcgaattgttatagtaggcaagtgcattgtcatcagtacaagctgtttgtgtggtaccagccgcacaggacatctgtcgtagtgctactggactcagttcattattctgtagtttaacagctgagttggctcttagagctgtaacaataagaggccaagccaaatttggtgaattgtccatgttaatttcactaagttgaacaatcttgctatccgcatcaacaacttgctggatttcccagagtgcagatgcatatgtaaaggtgttaccatcacaagtgttcttgtaggtaccataatcagggacaacaaccatgagtttggctgctgtagtcaatggtatgatgttgagtggaacacaaccatcacgcgcattgttgataatgttgttaagtgcatcattatcaagcttcctaagcatagtgaagagcattgtttgcatagcactagttacttttgccctcttgtcctcagatcttgcctgtttgtacatttgggtcatagcctgatctgccatcttttccaacttgcgttgcatggcagcatcacggtcaaactcagatttagccacattcaaagatttctttaactttttgagaacgacttcagaatcaccattagctacagcctgctcataggcctcctgggcagtggcataagcggcatatgatggtaaagaactaaattctgaagcaatagcctgaagagtagcacggttatcgagcatttcctcgcacaacctattaatgtctacagcaccctgcatggatagcaaaacagacaaaagagaaaccatcttctcgaaagcttcagttgtgtcttttgcaagaagaatatcattgtggagttgtacacattgtgcccacaatttagaagatgactctactctaagttgttgaagaaccgagagcagtaccacagatgtgcactttacgtcagacattttagactgtacagtagcaaccttgatacatggtttacctccaatacccaacaacttaatgttaagcttgaaagcatcaatactactcttaggaggcaaaagcccctgggagttcatatacctaaattcttgtgtagagaccaagtagtcataaacaccaagagtaagcctgaagtaacggttgagtaaacagaaaaggccaaagtagcagcagcaacaatagcctaagaaacaataaacaagcatgatacactgtaaggtgttgccagtaataaataacaatgggtaatactcaacacacacaaacactatagctctagctaaaaacatgatagtcgtaacgacaccagaatagttagaggttacagaaataactaaggcccacatggaaatagcttgatctaaagcattaccatagtagactttgtaaacaagtgtaatgacattcatcagtgtccaaacacgtctagcagcatcatcataaacagtgcgagctgtcatgagaataagcaaaactaaagctgaagcatacataacacaatccttaagcctataaccagacaagctagtgtcagccaattcaagccatgtcatgatacgcatcacccagctagcaggcatgtagaccatattaaagtaagcaactgttgcaagagaaggtaacagaaacaagcacaagaatgcgtgcttatgcttaacaagcagcatagcacatgcagcaattgccataataccaagagtaaatggcaagaaagcattctcgtaaacaaagaaaaacagtgaccactgtgtactttgaacaagaatcaatagtgatgtcaagaaagttaaaagcatccaatgatgagtgcccttaacaattttcttgaacttaccttggaaggtaacaccagagcattgtctaacaacatcaaatggtgtaaactcatcttctaaaatagtgctaccaaggatagtacgaccattcataccattctgcagcagctctttcaaagcagcacacatatctaagacggcaattcctgtttgagcagaaagaggtcccaatatgtcaacatgatcttgtgtcaaaggttcatagttgtacttcattgccacaaggttaaagtcattcaaagtagtggtgaatctattaagaaaccacctatcaccattgataacagcagcatacagccatgccaaaacatttaatgttatggttgtgtctgtacctgcagcctgtgcagtttgtctgtcaacaaatggaccatagaatttaccttctaagtcagtaccagcgtgtactcctgttggaagctccatatgatgcatatagcagaaagacacgcaatcataatcaatgttaaaaccaacactaccacatgatccattaaggaaagaacctttaatggtatgattaggtctcatggcacactgataaacaccagatggtgaaccattgtagcatgctagaactgaaaatgtttgaccaggttggatacggacaaatttatacttgggtgtcttagggttagaagtatcaactttaagcctaagcagacaattttgcatagaatggccaataacacgaagttgaacattgccagcctgaacaagaaagctatggttggatttgcgaatgagcagatcttcatagttaggattaagcatgtcttctgctgtgcaaatgacatgtcttggacagtatactgtgtcatccaaccacaatccattaagagttgtagttccacaggttacttgtaccatgcacccttcaactttgcctgacgggaatgccattttcctaaaaccactctgcagaacagcagaagtgattgatgtctgtggtggttggtagagaacatcagcacctgagttgctaaagtcatttagagcctttgctaagtggcagcaagctgcttcacgatagctggtagtatctaaggctccactgaaatacttgtacttgttatatagagcaagatacctgttatactgtgtaagtggcaacagtgtctcgctacgcaattttaggtacatttccttgttgagcaaaaaggtacacaaagcagcctcctcgaaggtactaaatgtaactccattaaacatgactcttttcctaagatagttgttaaagaaccaatggcagtgcttcagagaaatacagaatacatagattgctgttatccaaaaaggcacaataggagaaaacatggcaaaccattgaaggtgagccaagaatgaaacatcattggtgaaatagaatgtcaagtacaagtaaaagactgagtagactcccggcagaaagctgtaagctggtgccagacagagtatagtgaaagacatcaaaaacaaaagtgcattagcagcaacaacatggttgtactcaccaaaagcacgtctgaatttcataaagtagtaggcagcacaagtcaccaatatggcaataataccaccagccactactgaagcagacacatctaaagcacccacaggttgcacaagaggagtaaagatgttagctatgagattcatcgcatcaacaccacagaaaactcctgatagagctctgtaatgctcattattaagaacccatctaccactggtagataggcaaatacctacttctgacctttcgcatgtaccatgtctacagtactcagcatcaaaagttgttactactctaacagaaccctccaggtaagtgttaggaaactgtatgatggaaccatccataagcacataacgagtgtctggacgaagctcactataagaaatagaaccctctagcaaattagtgtcataacaatatggcacaggtttgcccatagcatccttaaaaattgtacactcagcagcaagaacgcaagcagaggtagcaaaatcactatactcaatgagtttggaaggtgtgtagcaaatgttgccaacagcactaaaaacacgaggtagaaaatgcaagaagtcaccattgattgctctcagcacagtacccggtaagccaggcactatgaaaccaatctctcttgtaatgatagcagctactacagggcagcttttgtcatttttgtatgaaccaccacgctggctaaaccatgcgtcaaaaccagcatgtttatttgcaaaacaatcatcagtagaaatgatgtcacgagtgacaccatcctgaatggctttgtaaccaatgatttcatttgtgtaaccatcatggattgacaatgtatgtactggcataacgatataacaaaccaatgcagcaagaacgcacaataatgtggccttaagcataagtttaaaacaagtactaacaatcttaccacccttgagtgagattttagtagttatgacattgacaacctgtctagttgtagcacaagttagtctaaaaggtatgttgttcttcttggcagcactacgaatttgtttacgcagctgttcagataaagacatgtagtcttttacattccagatgagtgaaacattgtgactttttgctacttgggcattgatatgccttgcattacagtcaatacatgcgccaagatctctgggcgtcatgttttcaaccttattataggtgagcatgaaattgttacaactgtcacctgtcacttctaagtcagagtgatgtgaaagtttgagacattcaataacatcctttgtgtcaacatcggtatcaacaacaccttgtcgggcagctgacacgaatgtagaaaggacaccatctaaagctacaccctttgctaactcgctgtgagctgtagcaacaagtgccttaagtttttccataggaacactaaaagttgctgaaaaggtgtcgacataagcatcaaacatcttaacggaaacttcagtactatctccaacgtctgatacaagagcttggtcaagcaacagaataggttggcacatcagctgactgtagtacacagaagcagacttagaagcagactcgtcgcatttggacttgccatcaaaaactatgacattaataggcagtgaacctttagtgttgttagctctcaaattgtctaaattgacaaaatgggagagaggatgtctctcataggtcttttgaccagccttgtcaaagtagaggtgaagcgcgccatttttcacagcaacactatcaacaatatacgatgactggtcagtagggttgattggtcttttaaactggagtgacaaatcacgagcaacttcatcactaatgaatgtactaccagtgcaaaatgtgtcacaattgagacaattccaattgtgagtcttgcagaagccacggcctccatttgcatagacatagaaagatctcttcatgccattaacaatagttgtacactcaacgcgtgtggcacgattgcgcttatagcacatcatgcaagtcgaagaggtgcaaccatccatgatatgaacatagctcttccatatgtagtagaaagaagcaaagaagatgtacatcctaaccattgcagaaacgggtgccatttgtacaatactaatgataaaccacatgagccaagaattgctgatgaaatgactagcaaaatagccaaagaacacctgcattatagctgaaagacctaataaataaaagaattttgtgaacaacatatatgccaaaacccactcagcggccagacctaaaattgtcaagtctagcttgtacgatgaaatcgtcacctgaatggtttcaagagctggataagaatcaagggagtctaatccacttaaacaaatgctgcaaggaaaagaaccttcacagaaatccatagtagtaacgttagacgaattaagatacaattctctaacgccattacaataagaaggagcaccaaaattagataagagtacaccaaaagcagcagttacacagattagagaacctaagcaaatacttaacaacaatagccacatagcgattgtgaacaatttagaaaatttgggtgacttcacataattaatgccggcatccaaacataatttagcaacactcttaacactatttttagcaatagttgtaggtagtgaagctctaattctagaattggtacttttagtaaaagtacacaattggaacaataatgtaaacacataaggcatataattgttaaacacacgttgtgctaatctcttagcgcaatttgatgttgtaattgctgcttgtcctaagaatggtttgacataagccaaaattttactccaaggaacactattaattgcagcaataccatgagtggcaattgtttttaaacctaaggctagtgaaagctcattaggtttcttaatggtaatgcttgtgttttccacataagcagccataagatcctcatgacctaactcttgtgttactttaacaccttcatctgatggtttaagtatgacattgcctacaacttcggtagttttcacgtcacactctatgacttccttctgtatggtaggattttccactacttcttcagaggtgggttgttgactttcacaagcaagattgtccattccttgtgtgtcttctactgccagaacttcaaatgaatttgaagtatctactggctttgtactccaaagacaacgtaaacaccaagtgtttggtttgaacgttgtcttggttgtagcctggttaatgtgccaaacaattggcttatgcagtaatttagcacctttcttgaaactcgctgaatagtgtctatagtcaatagccactacatcgccattcaagtctgggaagaatgtgacagatagctctcgtgaagctggctttgtgaagcctgtcatttgatttaaatcatcagcaaattttgtgttagaacatgtgagtttgaaattatcaaaactcgcatttggtaatggttgagttggtacaaggtctataggctgctctgtatagtaagcattatcctttttataatacccatccaattttggttcaatctctgtgtaagtaactccatcgagtttatacgacacaggcttgatggttgtagtgtaagatgtttccttgtagaaaacatcagtcactggtcctttgtactctgacatctttgtaaggtgagctccgtcaatacgatagagggtctccttagcagttatatgagtgtaatgaccacactgatagttaccagtgtactcattcgcacataagaatgtaccttgctgtaatttatactcagcaggtggtgcagacatcataacaaaagaagactcttgttgtactagatattgtgtagcatcacgaccacacacacatggaatggaaacacctgtcttaagattatcataagatagagtacccatatacatcacagcttctacacccgttaaggtagtagttttctgaccacaatgtttacacaccacattaagaactcgctttgcagattccaaattagcatgctgtagaagatgggtcatagtttctctgacatcaccaagctcgccaacagttttattactgtaagcgagtatgagtgcacaaaagttagcagcatcaccagcacgggctctataataagcctcttgaagtgctggtgcattgaatttgacttcaagctgttgaagtgctaataaaacactagacaaataacaattgttatcagcccatttaattgaagttaaaccaccaacttgaggaaatttccatttctttgtgtggtttaaagcagacatgtacctaccaagaaaactctcatcaagagtatggtagtactcgaaagcttcactacgtagtgtgtcatcactaggtagtacaaagaaagtcttaccctcatgatttacatgaggtttaatttttgtaacatcagcaccatccaagtatgttggaccaaactgctgtccatatgtcatagacatatccacaagctgtgtgtggagattagtgttgtccacagttgtgaacacttttatagtcttaacctcccgcagggataagagactctttagtttgtcaagtgaaagaacctcaccgtcaagatgaaactcgacggggctctccagagtgtggtacacaattttgtcaccacgcttaagaaattcaacacctaactctgtacgctgtcctgaataggaccaatctctgtaagagccagccaaagaaactgtttctacaaagtgctcctcagatgtctttgatgacgaagtgaggtatccattatatgtagtaacagcatctggtgatgatactgacactacggcaggagctttaagagaacgcatacagcgcgcagcctcttcaagattaaaaccatgtgtcacataaccaattggcattgtgacaagcggctcatttagagagttcagcttcgtaataatagaagctacaggctctttactagtataaaagaagaatcggacaccatagtcaacgatgccctcttgaattttaattcctttatacttacgttggatggttgccattatggctctaacatccatgcatataggcattaattttcttgtctcttcagcatgagcaagcatttctctcaaattccaggatacagttcctagaatctcttccttagcattaggtgcttctgaaggtagtacataaaatgcagatttgcatttcttaagagcagtcttagcttcctcaagtgtataaccagcacatccttgtccagggtacgtggttatatactcatcaactggcactttcttcaaagctcttgagagcatctcagtagtgccaccagcctttttggagggtattacaacacaagtgatatcaccactagtgataacatcacctaccatgtaaggtgcatccttctcaaggaaagacatatcttcacctctaagcatgttctgagaatcatggtaaagcttaccattgatatcagcaaacaagagtaacttattggtaagaaacttagtttcttccagtgttgtggtaacctcatcaatgcaggccttaatttttggcttcacatcgacaggcttctgtacgacagatttctcctcagttttggaatcttctgtgtttggtggctcctcttgtttaggtgcttccactctaggcttcaggttatcaagataatccatgacaacctgctcataaagagctttgtcattgactgcaatataaacctgtgtacgaaccgtctgcacgcacacttgtaaagactgaagtggtttagcaccaaatatgcctgctgacaacaatggtgcaagtaagatgtcctgtgaattgaaattttcatatgctgccttaagaagctggatgtcctcacctgcatttaggttaggtccaacaacatgcagacacttcttagcaagattatgtccagaaagcaaacaagaccctcctactgtaagagggccatttagcttaatgtaatcatcactctccttttgcatggcaccattggttgccttgttgagtgcacctgctacaccaccaccatgtttcaggtgtatgttagcagcatttacaatcaccataggattagcactttgtgcctccttaacgatgtcaacacatttaatggcaacattgtcagtaagttttaaataaccagtaaactgattaactggttcttcaggtgtaggttctggttctggctcaatctctgattgctcagtagtatcatccagccagtcttcctcttcttcttcctcaactcgaactgtttcagctgaggcaccaaattccagagggagaccttgataatcatcctctgtaccgtactcatgttcacaggtttcatcaatttcttcttcctcacactctgcatcgtcctcttcttcctcatctggagggtaaaaggaacaatacatacgtgatgaaaagttttcttcaccagcatcatcaaataagtagaatgtagctacactccactcatcaagatcaatacccatgttggtaaggagatcagaaactggttgtaaagtcttcacaacagcctctgctacaacacatgcaaactcagtaacttcggtaccggattcaacagtgtagacagagcacttttcattaagcactttgtcaacacgttcatcaagctcaaatgtgattctcacattcttgtaaccttgaacttcccaaacagtatcttctccaaaggttacacctttaattggtgcacccccttttaagcgaaagacattgtttgtagccagtaaaccaggagacaatgcgcagtattgttctttgtccttaatctctaagagcatgaggccatttacacagactggtgtgccaacgatagctccatttgtgaagctatcaacgggcgtctcgagtgcttcgagttcaccgttcttgagaacaacctcctcagaggtaagtactgtgtcatgtgaatcaccttcaagaaaggttacttcttttggtgccttaagaggcatgagtagttgcagctgctccttgccacgtatacactgacggtaaagtcccttgctttgagcgatgaagacttcacctaagttgagtgatcgcaactttgcgccagcgatagtgacttgatcaatgcacatttcgagtgccttgttaacaacatcaatgaagcattttacacaatccttgatgttatctgaagcaacctgtatttgacccttgacgatgtcaaaaacacctgtaatgagaaatttgagaatctcccaagcatccttgagaaattcaactcctgcactaagtttcgcctcaatccattcaaagataggcctgagtttttcaacagtagtgcccaaaagattagacaaccactgagaagtctgttgtacaagaccaccagttacatatgccataataatgacactgttggtgagcaggtctgaagtataaaccatggcgtcgacaagacgtaatgactgttcagaaataccatcaagtatggtgacagctgctctttgcaaatcaggaattgagtggtttgctgcatcaagtgtgcgcgcaaaaattgatctgataacaccagcagcctgtgagggaaaaccacacagtggtgttaaaactgatctctgttgtccaatgttccaagcaccttttacgggctttcccttggtaactttatagttaccgcaggactcaacaatggttttgaaagacttgtaatcaagactctttatagtgtcaataaaggcacttgtagaagcagagaaagatgccaaaatgatggcaacctcttcattcaaatgaaaatcgccaacaatgttaatgttaacacgttcacgactcagtatctcaaggagatcctcattcaaggtctccacattgtcaccagtaatgccagtatggcctgagccaatatcagcactagcacgaggaacccagtaggcacgcttattatagcagccaacataggcaaacacacagcctccaaaacatctagtcctacctcccttgcggagtcgagtttcaatgtttgagtggttgtgataatctgcaacactatgctcaggtccaatctctgggtcttgacaggcaggacatggcattttcactacagcattagtaggtaggtacccacatgtagtaggtccttcaataactaaattttcagtgccacaatgttcacaagtggctttcagaaagtcgcacgtctgccatgaaacttcatcgcaatgattacatttcatcaaggtagacaagtgcatattgttacactcctgtggagatgcaacagggtacacagagcgtatacgccccatgaaaccctcagtctttttcttttcaacacgtggttgaatgactttgacttttgagttaagaggaaacacaaactttgggcattcccctttgaaagtgtcaaatttcttggcactcttaatttcgaagggtgtctggtgctcgtagctcttatcagagcgctcagtgaaccaggcaatttcatgctcatggtcacggcagcagtagacacctctcttcgactcgatgtaatcaagttgttcggaaagagtgcacattgacttgcccgcgcgtgcgagaaaatctttgatgcaatcaagagggtacccatctgggccacagaaattgttgtcgacatagcgagtgactgcacctccattgagctcacgagtgagttcacggagtgcaccactgccatgcttagtgttccagttttgttcataatcttcaatgggatcagtgccaagctcgtcacctaagtcataagactttagatcgatgccatagctatgaccaccggctcccttattaccgttcttacgaagaagaacattgcggtatgcaattggggtttcgcccacatgtggcacgagtactcccagtgttataccgctacgaccgtactgaatgccgtccatttctgcaaccagctcaacgaccttgtggccgtgattggtgcttaaggcatcagaacgtttaatgaacacatagggctgttcaagctggggcagtacgcctttttccagctctactagaccacaagtgccatttttgaggtgttcacgtgcctccgatagggcctcttccacagagtccccgaagccacgcactagcacgtctctaacctgaaggacaggcaaactgagttggacgtgtgttttctcgttgacaccaagaacaaggctctccatcttacctttcggtcacacccggacgaaacctaggtatgctgatgatcgactgcaacacggacgaaaccgtaagcagtctgcagaagagggacgagttactcgtttcttgtcaacgacagtaaaatttattattgtttatactgcgtaggtgcactaggcatgcagccgagcgacagctacacagattttaaagttcgtttagagaacagatctacaagagatcgaggttggttggcttttcctgggtag

SEQ ID NO: 1103 - protein, 15 aa, Human severe acute respiratory syndrome virus
FFFFFFFFVILLRSY

SEQ ID NO: 1104 - protein, 53 aa, Human severe acute respiratory syndrome virus
NHMGIALLKLILHIRALPYRQLSLALFTVPSIVLRVASMKMWWLFQVLPNVTH

SEQ ID NO: 1105 - protein, 5 aa, Human severe acute respiratory syndrome virus
LKIAM

SEQ ID NO: 1106 - protein, 21 aa, Human severe acute respiratory syndrome virus
LNLLVLFSYENSFCTRVDYVS

SEQ ID NO: 1107 - protein, 23 aa, Human severe acute respiratory syndrome virus
TELRKRLHSPSALCGHHECLCLS

SEQ ID NO: 1108 - protein, 99 aa, Human severe acute respiratory syndrome virus
ISRSSTHGILKLSGEIIHVSRRKKSHSGLLLLSLRQRLSFISLFLFVLFRLCWWECFVCVNVLVQQYDVVFELWIFVIQFNGSMISQPCSRRCDFHANA

SEQ ID NO: 1109 - protein, 26 aa, Human severe acute respiratory syndrome virus
HSKECRGTWSKLCNLRPMFVISSLSD

SEQ ID NO: 1110 - protein, 66 aa, Human severe acute respiratory syndrome virus
VLVPEISLGLFWTTSPKCLSDVVLFCGSTFLARLFRCLSSRFLSDSLALLLLAFTRNFALKLVQSV

SEQ ID NO: 1111 - protein, 23 aa, Human severe acute respiratory syndrome virus
REGSFTTSASHSSRRISPTAARS

SEQ ID NO: 1112 - protein, 5 aa, Human severe acute respiratory syndrome virus
ITATT

SEQ ID NO: 1113 - protein, 27 aa, Human severe acute respiratory syndrome virus
GARRGLTAASASLCVEAFWQCCSLRKL

SEQ ID NO: 1114 - protein, 38 aa, Human severe acute respiratory syndrome virus
HGGSIVIRIAGANVVFGCIQGSLSCNPYDAFFVSAVGK

SEQ ID NO: 1115 - protein, 6 aa, Human severe acute respiratory syndrome virus
SFWASS

SEQ ID NO: 1116 - protein, 67 aa, Human severe acute respiratory syndrome virus
VIEVPSGAELFHFAVTTTNSSGSSSVVANLVIWTTIGVDWNALASRESKFLLAMLSESCEPRRSIIG

SEQ ID NO: 1117 - protein, 21 aa, Human severe acute respiratory syndrome virus
TLGSALFWPCPIASSILVIVS

SEQ ID NO: 1118 - protein, 15 aa, Human severe acute respiratory syndrome virus
ICGSTKCNAGGTTLV

SEQ ID NO: 1119 - protein, 20 aa, Human severe acute respiratory syndrome virus
LGSIIRHFNLFVYLKQQVRL

SEQ ID NO: 1120 - protein, 13 aa, Human severe acute respiratory syndrome virus
MQQFGDLHEGTNT

SEQ ID NO: 1121 - protein, 9 aa, Human severe acute respiratory syndrome virus
AHHQLDLDS

SEQ ID NO: 1122 - protein, 6 aa, Human severe acute respiratory syndrome virus
VCMFEP

SEQ ID NO: 1123 - protein, 23 aa, Human severe acute respiratory syndrome virus
CAIYEKVKPFLEHKAKQCYKYYP

SEQ ID NO: 1124 - protein, 10 aa, Human severe acute respiratory syndrome virus
CCTLQGSSST

SEQ ID NO: 1125 - protein, 30 aa, Human severe acute respiratory syndrome virus
GLLDAQRCTTVRMQLHREIQVKTMRSFMFV

SEQ ID NO: 1126 - protein, 34 aa, Human severe acute respiratory syndrome virus
TLVQGSSRSWISSENQNIISIIKTRNSRKAKKHK

SEQ ID NO: 1127 - protein, 13 aa, Human severe acute respiratory syndrome virus
KSIKVSSFILSFS

SEQ ID NO: 1128 - protein, 11 aa, Human severe acute respiratory syndrome virus
SKVLKILEQQQ

SEQ ID NO: 1129 - protein, 14 aa, Human severe acute respiratory syndrome virus
EKVASRALVEPPLV

SEQ ID NO: 1130 - protein, 27 aa, Human severe acute respiratory syndrome virus
KVLVKLILHAADRYVEYRQHKQKQSVC

SEQ ID NO: 1131 - protein, 34 aa, Human severe acute respiratory syndrome virus
CKLVQIYCQQEGEMVNCPRMFLMGKVLLVVQSYL

SEQ ID NO: 1132 - protein, 11 aa, Human severe acute respiratory syndrome virus
HTPDSDIARKM

SEQ ID NO: 1133 - protein, 8 aa, Human severe acute respiratory syndrome virus
IQSMSGRE

SEQ ID NO: 1134 - protein, 7 aa, Human severe acute respiratory syndrome virus
FSCSFYG

SEQ ID NO: 1135 - protein, 12 aa, Human severe acute respiratory syndrome virus
SNSIGSSSSNSE

SEQ ID NO: 1136 - protein, 45 aa, Human severe acute respiratory syndrome virus
FFLVRGLNNCLTIELIITSRFQIAILKVLIMIINISAIVTWKSTR

SEQ ID NO: 1137 - protein, 8 aa, Human severe acute respiratory syndrome virus
NICCHLLY

SEQ ID NO: 1138 - protein, 13 aa, Human severe acute respiratory syndrome virus
QSNIVVATGVVCI

SEQ ID NO: 1139 - protein, 14 aa, Human severe acute respiratory syndrome virus
FIVSNTVAVVCSKT

SEQ ID NO: 1140 - protein, 9 aa, Human severe acute respiratory syndrome virus
ISAYTLRRS

SEQ ID NO: 1141 - protein, 7 aa, Human severe acute respiratory syndrome virus
FVIRKRS

SEQ ID NO: 1142 - protein, 16 aa, Human severe acute respiratory syndrome virus
CSHSDLFWQVLNVTAP

SEQ ID NO: 1143 - protein, 44 aa, Human severe acute respiratory syndrome virus
GVSGHSQVTTNDHSTNDKFTFHERSGHNCPPERHIEKNVCFWVE

SEQ ID NO: 1144 - protein, 72 aa, Human severe acute respiratory syndrome virus
AGTSKQPEGSNEVAKPHQAYNTSHCNRNPASHPINSVDSSKHKTSKCYWPQEPEENKLYYVQKPVPIRIGKL

SEQ ID NO: 1145 - protein, 4 aa, Human severe acute respiratory syndrome virus
HNPG

SEQ ID NO: 1146 - protein, 4 aa, Human severe acute respiratory syndrome virus
ETYY

SEQ ID NO: 1147 - protein, 24 aa, Human severe acute respiratory syndrome virus
VPLFQELFKLLNGNSTVVCHDKQC

SEQ ID NO: 1148 - protein, 9 aa, Human severe acute respiratory syndrome virus
SSKQNNNNS

SEQ ID NO: 1149 - protein, 17 aa, Human severe acute respiratory syndrome virus
TRRSGTPSEEFRFLTRE

SEQ ID NO: 1150 - protein, 76 aa, Human severe acute respiratory syndrome virus
TVGFTKLTLTILQQYAHNRSAVRMASVTSKNTTKARKRSTLLTINVPVSSETNEYISSYSLSCAYKGTLVVVVGSS

SEQ ID NO: 1151 - protein, 50 aa, Human severe acute respiratory syndrome virus
IGSIAGLATPEEPSIVCICTFGGSLTSLLKMKNVAFSIPVSVVICVDSSW

SEQ ID NO: 1152 - protein, 4 aa, Human severe acute respiratory syndrome virus
TSVK

SEQ ID NO: 1153 - protein, 5 aa, Human severe acute respiratory syndrome virus
PCTTT

SEQ ID NO: 1154 - protein, 10 aa, Human severe acute respiratory syndrome virus
SLTPECLSSE

SEQ ID NO: 1155 - protein, 4 aa, Human severe acute respiratory syndrome virus
PPIW

SEQ ID NO: 1156 - protein, 27 aa, Human severe acute respiratory syndrome virus
SSLSFGVEMPSPSVTTIVSVTLLYGIQ

SEQ ID NO: 1157 - protein, 8 aa, Human severe acute respiratory syndrome virus
LCVCQQTK

SEQ ID NO: 1158 - protein, 31 aa, Human severe acute respiratory syndrome virus
SNGFLDLHFQQSQHLIIILHALMHCRKYIKA

SEQ ID NO: 1159 - protein, 17 aa, Human severe acute respiratory syndrome virus
RYKNCASIPAATSKRCE

SEQ ID NO: 1160 - protein, 16 aa, Human severe acute respiratory syndrome virus
MVTNSSSKLQMNWKPL

SEQ ID NO: 1161 - protein, 16 aa, Human severe acute respiratory syndrome virus
RASCHLLLSAIILVAL

SEQ ID NO: 1162 - protein, 26 aa, Human severe acute respiratory syndrome virus
KTARNATPITSHPKGSEACSGIVAVA

SEQ ID NO: 1163 - protein, 37 aa, Human severe acute respiratory syndrome virus
TVLAGEALSIFTGCAVIDPRVKNLINKSISSFMCNVI

SEQ ID NO: 1164 - protein, 20 aa, Human severe acute respiratory syndrome virus
ELAQSHPHQTCSKNHKSMHP

SEQ ID NO: 1165 - protein, 5 aa, Human severe acute respiratory syndrome virus
GNCNN

SEQ ID NO: 1166 - protein, 7 aa, Human severe acute respiratory syndrome virus
SCNKARL

SEQ ID NO: 1167 - protein, 7 aa, Human severe acute respiratory syndrome virus
RWQLVQQ

SEQ ID NO: 1168 - protein, 9 aa, Human severe acute respiratory syndrome virus
SRAKHTKAI

SEQ ID NO: 1169 - protein, 12 aa, Human severe acute respiratory syndrome virus
YIAHIFPILEGQ

SEQ ID NO: 1170 - protein, 6 aa, Human severe acute respiratory syndrome virus
VIHLNF

SEQ ID NO: 1171 - protein, 8 aa, Human severe acute respiratory syndrome virus
GGQFLFEC

SEQ ID NO: 1172 - protein, 4 aa, Human severe acute respiratory syndrome virus
RQKR

SEQ ID NO: 1173 - protein, 15 aa, Human severe acute respiratory syndrome virus
CLKCRQDQHLVMYDF

SEQ ID NO: 1174 - protein, 7 aa, Human severe acute respiratory syndrome virus
STCPALL

SEQ ID NO: 1175 - protein, 14 aa, Human severe acute respiratory syndrome virus
MSQAQVAEDHKLCC

SEQ ID NO: 1176 - protein, 12 aa, Human severe acute respiratory syndrome virus
RHHNFLRQMYCL

SEQ ID NO: 1177 - protein, 10 aa, Human severe acute respiratory syndrome virus
LFVEKRSSSV

SEQ ID NO: 1178 - protein, 5 aa, Human severe acute respiratory syndrome virus
TKKCH

SEQ ID NO: 1179 - protein, 21 aa, Human severe acute respiratory syndrome virus
TQKHLHEGSMLCLHDKLLALW

SEQ ID NO: 1180 - protein, 9 aa, Human severe acute respiratory syndrome virus
SSSPGMAHT

SEQ ID NO: 1181 - protein, 15 aa, Human severe acute respiratory syndrome virus
HVGRQHHAGLLVGRT

SEQ ID NO: 1182 - protein, 21 aa, Human severe acute respiratory syndrome virus
GGSPFHKSQLFLIVQEHTQTF

SEQ ID NO: 1183 - protein, 4 aa, Human severe acute respiratory syndrome virus
FQQP

SEQ ID NO: 1184 - protein, 15 aa, Human severe acute respiratory syndrome virus
LVVVLHRFEGFEVCL

SEQ ID NO: 1185 - protein, 28 aa, Human severe acute respiratory syndrome virus
LTCQFVPPPRLYQVAKGYHLAHLKLHQN

SEQ ID NO: 1186 - protein, 10 aa, Human severe acute respiratory syndrome virus
QVCLMLEHSG

SEQ ID NO: 1187 - protein, 13 aa, Human severe acute respiratory syndrome virus
QRLAACPMQLMLL

SEQ ID NO: 1188 - protein, 6 aa, Human severe acute respiratory syndrome virus
VILEFD

SEQ ID NO: 1189 - protein, 15 aa, Human severe acute respiratory syndrome virus
IGWRFVFGSHREHFG

SEQ ID NO: 1190 - protein, 4 aa, Human severe acute respiratory syndrome virus
LQCH

SEQ ID NO: 1191 - protein, 6 aa, Human severe acute respiratory syndrome virus
TYMPFA

SEQ ID NO: 1192 - protein, 20 aa, Human severe acute respiratory syndrome virus
QKVFEEQRQHQMSIQQWQYH

SEQ ID NO: 1193 - protein, 12 aa, Human severe acute respiratory syndrome virus
LEQQCRQQSYHQ

SEQ ID NO: 1194 - protein, 6 aa, Human severe acute respiratory syndrome virus
AEVATL

SEQ ID NO: 1195 - protein, 5 aa, Human severe acute respiratory syndrome virus
TSAHK

SEQ ID NO: 1196 - protein, 10 aa, Human severe acute respiratory syndrome virus
YHLGIRHIAS

SEQ ID NO: 1197 - protein, 9 aa, Human severe acute respiratory syndrome virus
SQHQRVSPY

SEQ ID NO: 1198 - protein, 5 aa, Human severe acute respiratory syndrome virus
RASPQ

SEQ ID NO: 1199 - protein, 12 aa, Human severe acute respiratory syndrome virus
LALEGQVIFVKN

SEQ ID NO: 1200 - protein, 14 aa, Human severe acute respiratory syndrome virus
NHQNISKLGFCTFV

SEQ ID NO: 1201 - protein, 34 aa, Human severe acute respiratory syndrome virus
LERTLHVCCDPVQQQYLRVHDLVVCKSYHIGEAN

SEQ ID NO: 1202 - protein, 13 aa, Human severe acute respiratory syndrome virus
NLRRCTYYNLRRF

SEQ ID NO: 1203 - protein, 6 aa, Human severe acute respiratory syndrome virus
KQALLL

SEQ ID NO: 1204 - protein, 4 aa, Human severe acute respiratory syndrome virus
QWCY

SEQ ID NO: 1205 - protein, 11 aa, Human severe acute respiratory syndrome virus
SKQLNYQHLKT

SEQ ID NO: 1206 - protein, 4 aa, Human severe acute respiratory syndrome virus
YKPQ

SEQ ID NO: 1207 - protein, 10 aa, Human severe acute respiratory syndrome virus
YYVIKKLYGN

SEQ ID NO: 1208 - protein, 6 aa, Human severe acute respiratory syndrome virus
HKCQLQ

SEQ ID NO: 1209 - protein, 14 aa, Human severe acute respiratory syndrome virus
ECRTHKKCRHAQLL

SEQ ID NO: 1210 - protein, 12 aa, Human severe acute respiratory syndrome virus
DSLLESGIHCFQ

SEQ ID NO: 1211 - protein, 7 aa, Human severe acute respiratory syndrome virus
NICAKLV

SEQ ID NO: 1212 - protein, 7 aa, Human severe acute respiratory syndrome virus
VDLHELL

SEQ ID NO: 1213 - protein, 5 aa, Human severe acute respiratory syndrome virus
KHQCS

SEQ ID NO: 1214 - protein, 16 aa, Human severe acute respiratory syndrome virus
HLDIEQQLQMKHLFQV

SEQ ID NO: 1215 - protein, 18 aa, Human severe acute respiratory syndrome virus
LHLHPQKSKVKCLIFQMF

SEQ ID NO: 1216 - protein, 6 aa, Human severe acute respiratory syndrome virus
DLERNQ

SEQ ID NO: 1217 - protein, 25 aa, Human severe acute respiratory syndrome virus
NQKHHGQIVEMVEISLKKELTHQYQ

SEQ ID NO: 1218 - protein, 4 aa, Human severe acute respiratory syndrome virus
HTGS

SEQ ID NO: 1219 - protein, 32 aa, Human severe acute respiratory syndrome virus
GQWIILVHKPWPVHLKVQKKVLQLCKVGSQCQ

SEQ ID NO: 1220 - protein, 13 aa, Human severe acute respiratory syndrome virus
WCKNHNHLMANNN

SEQ ID NO: 1221 - protein, 15 aa, Human severe acute respiratory syndrome virus
EQVGCKVCHQGRKAH

SEQ ID NO: 1222 - protein, 7 aa, Human severe acute respiratory syndrome virus
ICLSQRA

SEQ ID NO: 1223 - protein, 4 aa, Human severe acute respiratory syndrome virus
ACHV

SEQ ID NO: 1224 - protein, 12 aa, Human severe acute respiratory syndrome virus
DTYIYNYNYQLK

SEQ ID NO: 1225 - protein, 4 aa, Human severe acute respiratory syndrome virus
HQCS

SEQ ID NO: 1226 - protein, 8 aa, Human severe acute respiratory syndrome virus
YSKQGHNP

SEQ ID NO: 1227 - protein, 11 aa, Human severe acute respiratory syndrome virus
NHLAIYNYNQQ

SEQ ID NO: 1228 - protein, 14 aa, Human severe acute respiratory syndrome virus
HQFVLALFVLHHLP

SEQ ID NO: 1229 - protein, 16 aa, Human severe acute respiratory syndrome virus
LQKNLHRHWRSKDHST

SEQ ID NO: 1230 - protein, 7 aa, Human severe acute respiratory syndrome virus
WQKRHST

SEQ ID NO: 1231 - protein, 17 aa, Human severe acute respiratory syndrome virus
RLKKMLSCRAQSNQQHN

SEQ ID NO: 1232 - protein, 13 aa, Human severe acute respiratory syndrome virus
KFFFSPMHRQKGI

SEQ ID NO: 1233 - protein, 9 aa, Human severe acute respiratory syndrome virus
KPLQKDTSL

SEQ ID NO: 1234 - protein, 11 aa, Human severe acute respiratory syndrome virus
GISQHLLREQP

SEQ ID NO: 1235 - protein, 12 aa, Human severe acute respiratory syndrome virus
RSGKFLCQSQSS

SEQ ID NO: 1236 - protein, 13 aa, Human severe acute respiratory syndrome virus
VQQVDFENNQQHL

SEQ ID NO: 1237 - protein, 7 aa, Human severe acute respiratory syndrome virus
LYHFHHT

SEQ ID NO: 1238 - protein, 24 aa, Human severe acute respiratory syndrome virus
LALNSQQNRLQLTCPKCLEQVKRL

SEQ ID NO: 1239 - protein, 5 aa, Human severe acute respiratory syndrome virus
YQEAT

SEQ ID NO: 1240 - protein, 4 aa, Human severe acute respiratory syndrome virus
VSKC

SEQ ID NO: 1241 - protein, 10 aa, Human severe acute respiratory syndrome virus
NQKVDHELHL

SEQ ID NO: 1242 - protein, 14 aa, Human severe acute respiratory syndrome virus
VDSPYKHRETHLYF

SEQ ID NO: 1243 - protein, 7 aa, Human severe acute respiratory syndrome virus
TQTLVSV

SEQ ID NO: 1244 - protein, 21 aa, Human severe acute respiratory syndrome virus
NYLTFLKHQAKRHQICTRKCN

SEQ ID NO: 1245 - protein, 6 aa, Human severe acute respiratory syndrome virus
MHYRIS

SEQ ID NO: 1246 - protein, 8 aa, Human severe acute respiratory syndrome virus
YVSVYPWV

SEQ ID NO: 1247 - protein, 16 aa, Human severe acute respiratory syndrome virus
KQQRKGCHTIQSYMLV

SEQ ID NO: 1248 - protein, 9 aa, Human severe acute respiratory syndrome virus
SPTVTCCSW

SEQ ID NO: 1249 - protein, 21 aa, Human severe acute respiratory syndrome virus
NQKPNHGQHLISLWQQNKYHP

SEQ ID NO: 1250 - protein, 7 aa, Human severe acute respiratory syndrome virus
QGCQTYD

SEQ ID NO: 1251 - protein, 4 aa, Human severe acute respiratory syndrome virus
YETL

SEQ ID NO: 1252 - protein, 16 aa, Human severe acute respiratory syndrome virus
NKMEEINPELNKECLI

SEQ ID NO: 1253 - protein, 10 aa, Human severe acute respiratory syndrome virus
KFHQDSKPPS

SEQ ID NO: 1254 - protein, 7 aa, Human severe acute respiratory syndrome virus
MKYVECN

SEQ ID NO: 1255 - protein, 16 aa, Human severe acute respiratory syndrome virus
ELEHHQKWCTGQGHYH

SEQ ID NO: 1256 - protein, 5 aa, Human severe acute respiratory syndrome virus
EIIRK

SEQ ID NO: 1257 - protein, 6 aa, Human severe acute respiratory syndrome virus
TCSFSC

SEQ ID NO: 1258 - protein, 13 aa, Human severe acute respiratory syndrome virus
QEYHLKPQLCCFL

SEQ ID NO: 1259 - protein, 12 aa, Human severe acute respiratory syndrome virus
AYLFPEENKSYH

SEQ ID NO: 1260 - protein, 4 aa, Human severe acute respiratory syndrome virus
FDSP

SEQ ID NO: 1261 - protein, 9 aa, Human severe acute respiratory syndrome virus
ETLQQFLLI

SEQ ID NO: 1262 - protein, 15 aa, Human severe acute respiratory syndrome virus
EEICSCQRVNRKTTG

SEQ ID NO: 1263 - protein, 9 aa, Human severe acute respiratory syndrome virus
DLCSSRKCS

SEQ ID NO: 1264 - protein, 16 aa, Human severe acute respiratory syndrome virus
HAWYSHQFVPSACQDS

SEQ ID NO: 1265 - protein, 14 aa, Human severe acute respiratory syndrome virus
PQLKMLPMMMHLHL

SEQ ID NO: 1266 - protein, 10 aa, Human severe acute respiratory syndrome virus
QKLSTMRNGP

SEQ ID NO: 1267 - protein, 16 aa, Human severe acute respiratory syndrome virus
ACKGQHSKNALLSLQL

SEQ ID NO: 1268 - protein, 9 aa, Human severe acute respiratory syndrome virus
NHPGLVFAL

SEQ ID NO: 1269 - protein, 5 aa, Human severe acute respiratory syndrome virus
IHTDK

SEQ ID NO: 1270 - protein, 4 aa, Human severe acute respiratory syndrome virus
KTLL

SEQ ID NO: 1271 - protein, 10 aa, Human severe acute respiratory syndrome virus
SHSLLSHVWS

SEQ ID NO: 1272 - protein, 5 aa, Human severe acute respiratory syndrome virus
GHTYR

SEQ ID NO: 1273 - protein, 4 aa, Human severe acute respiratory syndrome virus
GPIY

SEQ ID NO: 1274 - protein, 11 aa, Human severe acute respiratory syndrome virus
PYVLLHSLQLK

SEQ ID NO: 1275 - protein, 8 aa, Human severe acute respiratory syndrome virus
NLRRRRSH

SEQ ID NO: 1276 - protein, 14 aa, Human severe acute respiratory syndrome virus
DLNRQVVCQLATIV

SEQ ID NO: 1277 - protein, 17 aa, Human severe acute respiratory syndrome virus
AQLYLVQLLYQSQHQSE

SEQ ID NO: 1278 - protein, 9 aa, Human severe acute respiratory syndrome virus
LSCCRVQLK

SEQ ID NO: 1279 - protein, 21 aa, Human severe acute respiratory syndrome virus
VYLSIDTVEYTLRHSSLFLLV

SEQ ID NO: 1280 - protein, 22 aa, Human severe acute respiratory syndrome virus
QHFHHNSEGHTFQEAFFASCTS

SEQ ID NO: 1281 - protein, 28 aa, Human severe acute respiratory syndrome virus
ASQHLVATLDLLVVLGRRFQHVHPYTKA

SEQ ID NO: 1282 - protein, 8 aa, Human severe acute respiratory syndrome virus
MKFQHSQL

SEQ ID NO: 1283 - protein, 38 aa, Human severe acute respiratory syndrome virus
PLLKSLTNLVTLLSRQSHQVKDQSQNTHILMNLFAHLL

SEQ ID NO: 1284 - protein, 8 aa, Human severe acute respiratory syndrome virus
SNFSLCCP

SEQ ID NO: 1285 - protein, 4 aa, Human severe acute respiratory syndrome virus
NPLI

SEQ ID NO: 1286 - protein, 22 aa, Human severe acute respiratory syndrome virus
VVNLVSAWLSLSLNEDRQVVHD

SEQ ID NO: 1287 - protein, 18 aa, Human severe acute respiratory syndrome virus
NLHKRCVRRHSPRAYIAV

SEQ ID NO: 1288 - protein, 13 aa, Human severe acute respiratory syndrome virus
RARESQFPFVIWA

SEQ ID NO: 1289 - protein, 8 aa, Human severe acute respiratory syndrome virus
NPLSLCSE

SEQ ID NO: 1290 - protein, 8 aa, Human severe acute respiratory syndrome virus
SRFQATVE

SEQ ID NO: 1291 - protein, 5 aa, Human severe acute respiratory syndrome virus
CRLLS

SEQ ID NO: 1292 - protein, 10 aa, Human severe acute respiratory syndrome virus
TVFLLILQLM

SEQ ID NO: 1293 - protein, 11 aa, Human severe acute respiratory syndrome virus
LVLVPLKVLDL

SEQ ID NO: 1294 - protein, 13 aa, Human severe acute respiratory syndrome virus
LNLLLLKHHYGRF

SEQ ID NO: 1295 - protein, 14 aa, Human severe acute respiratory syndrome virus
KGLPVLPLYHQTRQ

SEQ ID NO: 1296 - protein, 7 aa, Human severe acute respiratory syndrome virus
VKNKHSQ

SEQ ID NO: 1297 - protein, 13 aa, Human severe acute respiratory syndrome virus
VSWQCQSLCRHLL

SEQ ID NO: 1298 - protein, 15 aa, Human severe acute respiratory syndrome virus
IHVLGLLFCSPRLQY

SEQ ID NO: 1299 - protein, 8 aa, Human severe acute respiratory syndrome virus
QRYQHPNY

SEQ ID NO: 1300 - protein, 5 aa, Human severe acute respiratory syndrome virus
SLALV

SEQ ID NO: 1301 - protein, 7 aa, Human severe acute respiratory syndrome virus
PKAQMQH

SEQ ID NO: 1302 - protein, 23 aa, Human severe acute respiratory syndrome virus
QEVLSYFQRSPHQYHLPLCKQHY

SEQ ID NO: 1303 - protein, 15 aa, Human severe acute respiratory syndrome virus
WKQVLRRRVHQSVLY

SEQ ID NO: 1304 - protein, 13 aa, Human severe acute respiratory syndrome virus
QHYKPHFLNSVTW

SEQ ID NO: 1305 - protein, 16 aa, Human severe acute respiratory syndrome virus
MYSTGYKYQIVCKSIG

SEQ ID NO: 1306 - protein, 31 aa, Human severe acute respiratory syndrome virus
IQQKSSYYMHPSTVGTHLHGVCKQHHLNCIV

SEQ ID NO: 1307 - protein, 30 aa, Human severe acute respiratory syndrome virus
VEHNQYPTLLVCHETHKDYQNSKRKAIALN

SEQ ID NO: 1308 - protein, 58 aa, Human severe acute respiratory syndrome virus
MHFYRKLECGMHAYSHTNYHHHSLVSSSLTRLLCQTYTQLHWLGNDQRYNSKTNKHHQ

SEQ ID NO: 1309 - protein, 5 aa, Human severe acute respiratory syndrome virus
IYRDV

SEQ ID NO: 1310 - protein, 32 aa, Human severe acute respiratory syndrome virus
HKNRRAPLFCKLCHYMAEHRRTSILLQPEAHT

SEQ ID NO: 1311 - protein, 31 aa, Human severe acute respiratory syndrome virus
PLDFQCHEELETYQQAMQTSQPCVVLFCKQN

SEQ ID NO: 1312 - protein, 6 aa, Human severe acute respiratory syndrome virus
PSVHLL

SEQ ID NO: 1313 - protein, 9 aa, Human severe acute respiratory syndrome virus
GIQQTNQRA

SEQ ID NO: 1314 - protein, 9 aa, Human severe acute respiratory syndrome virus
QSTHGLLNI

SEQ ID NO: 1315 - protein, 20 aa, Human severe acute respiratory syndrome virus
PHVHFHVPGNVGHGYSEGYP

SEQ ID NO: 1316 - protein, 8 aa, Human severe acute respiratory syndrome virus
SPTAEHQS

SEQ ID NO: 1317 - protein, 21 aa, Human severe acute respiratory syndrome virus
MGYRHSQNPQNDSSRHKYLMK

SEQ ID NO: 1318 - protein, 18 aa, Human severe acute respiratory syndrome virus
KSKLHVCHTDNTFFQVQS

SEQ ID NO: 1319 - protein, 6 aa, Human severe acute respiratory syndrome virus
QSTSLM

SEQ ID NO: 1320 - protein, 21 aa, Human severe acute respiratory syndrome virus
AQSHAPKGRTRLCLTILSVYH

SEQ ID NO: 1321 - protein, 5 aa, Human severe acute respiratory syndrome virus
AFVLS

SEQ ID NO: 1322 - protein, 11 aa, Human severe acute respiratory syndrome virus
YALHSRASLYT

SEQ ID NO: 1323 - protein, 9 aa, Human severe acute respiratory syndrome virus
TGHLVEVLH

SEQ ID NO: 1324 - protein, 17 aa, Human severe acute respiratory syndrome virus
ILCYFQCQHNQSVQLLS

SEQ ID NO: 1325 - protein, 8 aa, Human severe acute respiratory syndrome virus
KILAGEVG

SEQ ID NO: 1326 - protein, 5 aa, Human severe acute respiratory syndrome virus
YPQHL

SEQ ID NO: 1327 - protein, 17 aa, Human severe acute respiratory syndrome virus
LHDSPLHQSQSTHERDE

SEQ ID NO: 1328 - protein, 4 aa, Human severe acute respiratory syndrome virus
LLRG

SEQ ID NO: 1329 - protein, 5 aa, Human severe acute respiratory syndrome virus
LGNSF

SEQ ID NO: 1330 - protein, 20 aa, Human severe acute respiratory syndrome virus
VYGRSCPLVCLVCQHIILQS

SEQ ID NO: 1331 - protein, 5 aa, Human severe acute respiratory syndrome virus
TLYQR

SEQ ID NO: 1332 - protein, 4 aa, Human severe acute respiratory syndrome virus
DEDQ

SEQ ID NO: 1333 - protein, 5 aa, Human severe acute respiratory syndrome virus
SYYSP

SEQ ID NO: 1334 - protein, 10 aa, Human severe acute respiratory syndrome virus
KVQLHFLLVM

SEQ ID NO: 1335 - protein, 10 aa, Human severe acute respiratory syndrome virus
PHCDVVFLDL

SEQ ID NO: 1336 - protein, 21 aa, Human severe acute respiratory syndrome virus
IAVCHKDLYQTLCTKCQFLPL

SEQ ID NO: 1337 - protein, 8 aa, Human severe acute respiratory syndrome virus
HYKSVLFQ

SEQ ID NO: 1338 - protein, 14 aa, Human severe acute respiratory syndrome virus
HSHIQNPVMNQQSA

SEQ ID NO: 1339 - protein, 17 aa, Human severe acute respiratory syndrome virus
AILRFLKLQRSVNYKVR

SEQ ID NO: 1340 - protein, 10 aa, Human severe acute respiratory syndrome virus
KQLFSKQDCV

SEQ ID NO: 1341 - protein, 11 aa, Human severe acute respiratory syndrome virus
EILLQRLFEVC

SEQ ID NO: 1342 - protein, 7 aa, Human severe acute respiratory syndrome virus
LQMKHHV

SEQ ID NO: 1343 - protein, 6 aa, Human severe acute respiratory syndrome virus
HLCRTF

SEQ ID NO: 1344 - protein, 43 aa, Human severe acute respiratory syndrome virus
SIELTSPCVLLAYCHKLKHSQCQQFQQDNGDKFQGTCLDLLFS

SEQ ID NO: 1345 - protein, 5 aa, Human severe acute respiratory syndrome virus
VCTLN

SEQ ID NO: 1346 - protein, 8 aa, Human severe acute respiratory syndrome virus
NILVLVCL

SEQ ID NO: 1347 - protein, 23 aa, Human severe acute respiratory syndrome virus
SAMCGGLVIEQDRQYRRSVLHEV

SEQ ID NO: 1348 - protein, 6 aa, Human severe acute respiratory syndrome virus
QHSSHN

SEQ ID NO: 1349 - protein, 30 aa, Human severe acute respiratory syndrome virus
RFHQRLQCQQLFLAMHLQCRKHTVLVLNSL

SEQ ID NO: 1350 - protein, 12 aa, Human severe acute respiratory syndrome virus
IYQNTLRAHAQV

SEQ ID NO: 1351 - protein, 54 aa, Human severe acute respiratory syndrome virus
FYYIYLWANILMPFHIGHQQLHESMPYTLCEQMGNREQVRWQNDSYQYQVVLGV

SEQ ID NO: 1352 - protein, 14 aa, Human severe acute respiratory syndrome virus
STFACRPFDNLQHC

SEQ ID NO: 1353 - protein, 6 aa, Human severe acute respiratory syndrome virus
KTHLRC

SEQ ID NO: 1354 - protein, 6 aa, Human severe acute respiratory syndrome virus
VLGTSQ

SEQ ID NO: 1355 - protein, 10 aa, Human severe acute respiratory syndrome virus
FSHSALVALE

SEQ ID NO: 1356 - protein, 20 aa, Human severe acute respiratory syndrome virus
VALQCEMSTQSNHQHSTCMS

SEQ ID NO: 1357 - protein, 25 aa, Human severe acute respiratory syndrome virus
YLCTQQHHHSHLFQRCTLQSVLYYF

SEQ ID NO: 1358 - protein, 5 aa, Human severe acute respiratory syndrome virus
LHGNQ

SEQ ID NO: 1359 - protein, 9 aa, Human severe acute respiratory syndrome virus
RHSFCSMVV

SEQ ID NO: 1360 - protein, 26 aa, Human severe acute respiratory syndrome virus
VFQPPMKDAILCQRVLRVQWQYHMTA

SEQ ID NO: 1361 - protein, 6 aa, Human severe acute respiratory syndrome virus
MFPQWL

SEQ ID NO: 1362 - protein, 7 aa, Human severe acute respiratory syndrome virus
AFLLRKA

SEQ ID NO: 1363 - protein, 14 aa, Human severe acute respiratory syndrome virus
VSQYKCWQVCNRQH

SEQ ID NO: 1364 - protein, 8 aa, Human severe acute respiratory syndrome virus
SNHMLLSH

SEQ ID NO: 1365 - protein, 17 aa, Human severe acute respiratory syndrome virus
HCHCLHMCFCINQKPDH

SEQ ID NO: 1366 - protein, 5 aa, Human severe acute respiratory syndrome virus
HIMEN

SEQ ID NO: 1367 - protein, 21 aa, Human severe acute respiratory syndrome virus
WEAYVTCNNSSYLLDTVVSHQ

SEQ ID NO: 1368 - protein, 11 aa, Human severe acute respiratory syndrome virus
HHNLGHCKHRD

SEQ ID NO: 1369 - protein, 10 aa, Human severe acute respiratory syndrome virus
QTTLICVMLK

SEQ ID NO: 1370 - protein, 13 aa, Human severe acute respiratory syndrome virus
HGHSSTCNIGMVS

SEQ ID NO: 1371 - protein, 28 aa, Human severe acute respiratory syndrome virus
YRHRNEVKSVNCTIHKHLQPARLYVVCT

SEQ ID NO: 1372 - protein, 14 aa, Human severe acute respiratory syndrome virus
PHKTQVPSTVRCYH

SEQ ID NO: 1373 - protein, 12 aa, Human severe acute respiratory syndrome virus
LALRNTCPTCGQ

SEQ ID NO: 1374 - protein, 6 aa, Human severe acute respiratory syndrome virus
AHHVTF

SEQ ID NO: 1375 - protein, 14 aa, Human severe acute respiratory syndrome virus
CIVNTSERHQHTPD

SEQ ID NO: 1376 - protein, 5 aa, Human severe acute respiratory syndrome virus
VGKHQ

SEQ ID NO: 1377 - protein, 8 aa, Human severe acute respiratory syndrome virus
PVTRTFQS

SEQ ID NO: 1378 - protein, 5 aa, Human severe acute respiratory syndrome virus
VYHLF

SEQ ID NO: 1379 - protein, 27 aa, Human severe acute respiratory syndrome virus
QYHRQNSLRLIFLMDLGKAGTRNHLLV

SEQ ID NO: 1380 - protein, 13 aa, Human severe acute respiratory syndrome virus
LALYAVSKIREVL

SEQ ID NO: 1381 - protein, 11 aa, Human severe acute respiratory syndrome virus
GQSQSNILPQT

SEQ ID NO: 1382 - protein, 10 aa, Human severe acute respiratory syndrome virus
THYFDNKELP

SEQ ID NO: 1383 - protein, 76 aa, Human severe acute respiratory syndrome virus
LLNLEPHSYCYSTQRHHQKESSWRNVYAGKRKTHPRIHDQHPYFYRDTHRACVVDCGHTCQLSYYHQLKEVHLHWL

SEQ ID NO: 1384 - protein, 5 aa, Human severe acute respiratory syndrome virus
QLDKC

SEQ ID NO: 1385 - protein, 4 aa, Human severe acute respiratory syndrome virus
HKQL

SEQ ID NO: 1386 - protein, 9 aa, Human severe acute respiratory syndrome virus
HHRMMFHLV

SEQ ID NO: 1387 - protein, 7 aa, Human severe acute respiratory syndrome virus
HIVSRHT

SEQ ID NO: 1388 - protein, 10 aa, Human severe acute respiratory syndrome virus
PSHLILAHTR

SEQ ID NO: 1389 - protein, 25 aa, Human severe acute respiratory syndrome virus
LTCRNGVISYSKCYVCEQEQERPLS

SEQ ID NO: 1390 - protein, 12 aa, Human severe acute respiratory syndrome virus
AWLCHILDNPNP

SEQ ID NO: 1391 - protein, 28 aa, Human severe acute respiratory syndrome virus
GVEFLHHCKQFLTYYASHRKTCLFQLPQ

SEQ ID NO: 1392 - protein, 16 aa, Human severe acute respiratory syndrome virus
WRLLTSIISDETVYLS

SEQ ID NO: 1393 - protein, 12 aa, Human severe acute respiratory syndrome virus
RHQLRCELYSLH

SEQ ID NO: 1394 - protein, 5 aa, Human severe acute respiratory syndrome virus
DSFEL

SEQ ID NO: 1395 - protein, 18 aa, Human severe acute respiratory syndrome virus
YTRKVHLDPHNSLSHNKV

SEQ ID NO: 1396 - protein, 5 aa, Human severe acute respiratory syndrome virus
PYPIY

SEQ ID NO: 1397 - protein, 10 aa, Human severe acute respiratory syndrome virus
MGNQLIYPDC

SEQ ID NO: 1398 - protein, 6 aa, Human severe acute respiratory syndrome virus
RLLGWH

SEQ ID NO: 1399 - protein, 21 aa, Human severe acute respiratory syndrome virus
YSHHRNNQSIYQQLQLRIGVV

SEQ ID NO: 1400 - protein, 15 aa, Human severe acute respiratory syndrome virus
YHTLLADYNDNSHNH

SEQ ID NO: 1401 - protein, 19 aa, Human severe acute respiratory syndrome virus
QRCHPEQRRSVLVQQNFLP

SEQ ID NO: 1402 - protein, 9 aa, Human severe acute respiratory syndrome virus
TQQSHKSLY

SEQ ID NO: 1403 - protein, 4 aa, Human severe acute respiratory syndrome virus
NYRV

SEQ ID NO: 1404 - protein, 16 aa, Human severe acute respiratory syndrome virus
QFEKQHCLLVQLLKSM

SEQ ID NO: 1405 - protein, 13 aa, Human severe acute respiratory syndrome virus
CVYLAINCQKLHA

SEQ ID NO: 1406 - protein, 10 aa, Human severe acute respiratory syndrome virus
LDQQHTLKVP

SEQ ID NO: 1407 - protein, 42 aa, Human severe acute respiratory syndrome virus
DASYVSLHPDYVRLLTHENGIQLKQQKEHHLQIFFLLVVQNL

SEQ ID NO: 1408 - protein, 4 aa, Human severe acute respiratory syndrome virus
VETQ

SEQ ID NO: 1409 - protein, 4 aa, Human severe acute respiratory syndrome virus
KITH

SEQ ID NO: 1410 - protein, 13 aa, Human severe acute respiratory syndrome virus
SLHNEGYTYHPNS

SEQ ID NO: 1411 - protein, 11 aa, Human severe acute respiratory syndrome virus
YNWDGMSGPNI

SEQ ID NO: 1412 - protein, 11 aa, Human severe acute respiratory syndrome virus
NNGRRDKVSLP

SEQ ID NO: 1413 - protein, 8 aa, Human severe acute respiratory syndrome virus
NHISANPT

SEQ ID NO: 1414 - protein, 16 aa, Human severe acute respiratory syndrome virus
VVLRDQHPYGTQQPMP

SEQ ID NO: 1415 - protein, 12 aa, Human severe acute respiratory syndrome virus
GWASAMSNMNPQ

SEQ ID NO: 1416 - protein, 19 aa, Human severe acute respiratory syndrome virus
ELRSLVLLVRNHRNRTSSH

SEQ ID NO: 1417 - protein, 16 aa, Human severe acute respiratory syndrome virus
DPDYLMSVRLQCLHHA

SEQ ID NO: 1418 - protein, 18 aa, Human severe acute respiratory syndrome virus
HRRIVQSLIMIGVHAHLS

SEQ ID NO: 1419 - protein, 18 aa, Human severe acute respiratory syndrome virus
HIRVRCQDSLRSHTNPSY

SEQ ID NO: 1420 - protein, 9 aa, Human severe acute respiratory syndrome virus
NNHHHSNCM

SEQ ID NO: 1421 - protein, 26 aa, Human severe acute respiratory syndrome virus
RVFLLMYHNYPHQNDVEHRLNQPLCI

SEQ ID NO: 1422 - protein, 15 aa, Human severe acute respiratory syndrome virus
LDADVIYVVPCHHLL

SEQ ID NO: 1423 - protein, 11 aa, Human severe acute respiratory syndrome virus
KSHGQQPLDNL

SEQ ID NO: 1424 - protein, 4 aa, Human severe acute respiratory syndrome virus
PSYK

SEQ ID NO: 1425 - protein, 6 aa, Human severe acute respiratory syndrome virus
SLHVGS

SEQ ID NO: 1426 - protein, 20 aa, Human severe acute respiratory syndrome virus
LQSKSLINCLPHPSPGSDSN

SEQ ID NO: 1427 - protein, 24 aa, Human severe acute respiratory syndrome virus
FLGTLQNQQLFRCKYQKPCRRHQY

SEQ ID NO: 1428 - protein, 6 aa, Human severe acute respiratory syndrome virus
CLCRTV

SEQ ID NO: 1429 - protein, 10 aa, Human severe acute respiratory syndrome virus
DGLHLHRKPV

SEQ ID NO: 1430 - protein, 71 aa, Human severe acute respiratory syndrome virus
CIRRLHQGFAELVTTTAITFPHSADGTDCVSKCKTHWVISTSGRYLDVLTFQVTESFRIWMVNVASTIQTT

SEQ ID NO: 1431 - protein, 40 aa, Human severe acute respiratory syndrome virus
STTKGLLVHVSFWCYSNCLSCTSVCTQHLHTVGDWLSSTC

SEQ ID NO: 1432 - protein, 19 aa, Human severe acute respiratory syndrome virus
VILICFSRVYCKSTEGKHS

SEQ ID NO: 1433 - protein, 17 aa, Human severe acute respiratory syndrome virus
IGRYFCSISSLKTYCSS

SEQ ID NO: 1434 - protein, 8 aa, Human severe acute respiratory syndrome virus
TAQHHTSI

SEQ ID NO: 1435 - protein, 47 aa, Human severe acute respiratory syndrome virus
AFDEVQVFHFRPFWCVCNKPTRWFQFCVNCTCTITLRESSPFEILVV

SEQ ID NO: 1436 - protein, 34 aa, Human severe acute respiratory syndrome virus
CQHKPTSLRIVIVGKCIVISTSCLCGTSRTGHLS

SEQ ID NO: 1437 - protein, 9 aa, Human severe acute respiratory syndrome virus
CYWTQFIIL

SEQ ID NO: 1438 - protein, 11 aa, Human severe acute respiratory syndrome virus
SCNNKRPSQIW

SEQ ID NO: 1439 - protein, 138 aa, Human severe acute respiratory syndrome virus
IVHVNFTKLNNLAIRINNLLDFPECRCICKGVTITSVLVGTIIRDNNHEFGCCSQWYDVEWNTTITRIVDNVVKCIIIKLPKHSEEHCLHSTSYFCPLVLRSCLFVHLGHSLICHLFQLALHGSITVKLRFSHIQRFL

SEQ ID NO: 1440 - protein, 26 aa, Human severe acute respiratory syndrome virus
LFENDFRITISYSLLIGLLGSGISGI

SEQ ID NO: 1441 - protein, 4 aa, Human severe acute respiratory syndrome virus
RTKF

SEQ ID NO: 1442 - protein, 26 aa, Human severe acute respiratory syndrome virus
SNSLKSSTVIEHFLAQPINVYSTLHG

SEQ ID NO: 1443 - protein, 35 aa, Human severe acute respiratory syndrome virus
QNRQKRNHLLESFSCVFCKKNIIVELYTLCPQFRR

SEQ ID NO: 1444 - protein, 83 aa, Human severe acute respiratory syndrome virus
LYSKLLKNREQYHRCALYVRHFRLYSSNLDTWFTSNTQQLNVKLESINTTLRRQKPLGVHIPKFLCRDQVVINTKSKPEVTVE

SEQ ID NO: 1445 - protein, 12 aa, Human severe acute respiratory syndrome virus
TEKAKVAAATIA

SEQ ID NO: 1446 - protein, 9 aa, Human severe acute respiratory syndrome virus
ETINKHDTL

SEQ ID NO: 1447 - protein, 6 aa, Human severe acute respiratory syndrome virus
GVASNK

SEQ ID NO: 1448 - protein, 14 aa, Human severe acute respiratory syndrome virus
QWVILNTHKHYSSS

SEQ ID NO: 1449 - protein, 17 aa, Human severe acute respiratory syndrome virus
KHDSRNDTRIVRGYRNN

SEQ ID NO: 1450 - protein, 8 aa, Human severe acute respiratory syndrome virus
GPHGNSLI

SEQ ID NO: 1451 - protein, 37 aa, Human severe acute respiratory syndrome virus
SITIVDFVNKCNDIHQCPNTSSSIIINSASCHENKQN

SEQ ID NO: 1452 - protein, 45 aa, Human severe acute respiratory syndrome virus
SIHNTILKPITRQASVSQFKPCHDTHHPASRHVDHIKVSNCCKRR

SEQ ID NO: 1453 - protein, 39 aa, Human severe acute respiratory syndrome virus
QKQAQECVLMLNKQHSTCSNCHNTKSKWQESILVNKEKQ

SEQ ID NO: 1454 - protein, 9 aa, Human severe acute respiratory syndrome virus
PLCTLNKNQ

SEQ ID NO: 1455 - protein, 4 aa, Human severe acute respiratory syndrome virus
CQES

SEQ ID NO: 1456 - protein, 34 aa, Human severe acute respiratory syndrome virus
KHPMMSALNNFLELTLEGNTRALSNNIKWCKLIF

SEQ ID NO: 1457 - protein, 24 aa, Human severe acute respiratory syndrome virus
NSATKDSTTIHTILQQLFQSSTHI

SEQ ID NO: 1458 - protein, 59 aa, Human severe acute respiratory syndrome virus
DGNSCLSRKRSQYVNMILCQRFIVVLHCHKVKVIQSSGESIKKPPITIDNSSIQPCQNI

SEQ ID NO: 1459 - protein, 24 aa, Human severe acute respiratory syndrome virus
CYGCVCTCSLCSLSVNKWTIEFTF

SEQ ID NO: 1460 - protein, 32 aa, Human severe acute respiratory syndrome virus
VSTSVYSCWKLHMMHIAERHAIIINVKTNTTT

SEQ ID NO: 1461 - protein, 22 aa, Human severe acute respiratory syndrome virus
SIKERTFNGMIRSHGTLINTRW

SEQ ID NO: 1462 - protein, 5 aa, Human severe acute respiratory syndrome virus
TIVAC

SEQ ID NO: 1463 - protein, 102 aa, Human severe acute respiratory syndrome virus
KCLTRLDTDKFILGCLRVRSINFKPKQTILHRMANNTKLNIASLNKKAMVGFANEQIFIVRIKHVFCCANDMSWTVYCVIQPQSIKSCSSTGYLYHAPFNFA

SEQ ID NO: 1464 - protein, 16 aa, Human severe acute respiratory syndrome virus
RECHFPKTTLQNSRSD

SEQ ID NO: 1465 - protein, 11 aa, Human severe acute respiratory syndrome virus
CLWWLVENIST

SEQ ID NO: 1466 - protein, 5 aa, Human severe acute respiratory syndrome virus
VAKVI

SEQ ID NO: 1467 - protein, 12 aa, Human severe acute respiratory syndrome virus
VAASCFTIAGSI

SEQ ID NO: 1468 - protein, 10 aa, Human severe acute respiratory syndrome virus
GSTEILVLVI

SEQ ID NO: 1469 - protein, 18 aa, Human severe acute respiratory syndrome virus
SKIPVILCKWQQCLATQF

SEQ ID NO: 1470 - protein, 69 aa, Human severe acute respiratory syndrome virus
VHFLVEQKGTQSSLLEGTKCNSIKHDSFPKIVVKEPMAVLQRNTEYIDCCYPKRHNRRKHGKPLKVSQE

SEQ ID NO: 1471 - protein, 14 aa, Human severe acute respiratory syndrome virus
NIIGEIECQVQVKD

SEQ ID NO: 1472 - protein, 59 aa, Human severe acute respiratory syndrome virus
VDSRQKAVSWCQTEYSERHQKQKCISSNNMVVLTKSTSEFHKVVGSTSHQYGNNTTSHY

SEQ ID NO: 1473 - protein, 4 aa, Human severe acute respiratory syndrome virus
SRHI

SEQ ID NO: 1474 - protein, 25 aa, Human severe acute respiratory syndrome virus
STHRLHKRSKDVSYEIHRINTTENS

SEQ ID NO: 1475 - protein, 15 aa, Human severe acute respiratory syndrome virus
SSVMLIIKNPSTTGR

SEQ ID NO: 1476 - protein, 5 aa, Human severe acute respiratory syndrome virus
ANTYF

SEQ ID NO: 1477 - protein, 52 aa, Human severe acute respiratory syndrome virus
PFACTMSTVLSIKSCYYSNRTLQVSVRKLYDGTIHKHITSVWTKLTIRNRTL

SEQ ID NO: 1478 - protein, 53 aa, Human severe acute respiratory syndrome virus
QISVITIWHRFAHSILKNCTLSSKNASRGSKITILNEFGRCVANVANSTKNTR

SEQ ID NO: 1479 - protein, 15 aa, Human severe acute respiratory syndrome virus
KMQEVTIDCSQHSTR

SEQ ID NO: 1480 - protein, 24 aa, Human severe acute respiratory syndrome virus
ARHYETNLSCNDSSYYRAAFVIFV

SEQ ID NO: 1481 - protein, 46 aa, Human severe acute respiratory syndrome virus
TTTLAKPCVKTSMFICKTIISRNDVTSDTILNGFVTNDFICVTIMD

SEQ ID NO: 1482 - protein, 18 aa, Human severe acute respiratory syndrome virus
QCMYWHNDITNQCSKNAQ

SEQ ID NO: 1483 - protein, 18 aa, Human severe acute respiratory syndrome virus
CGLKHKFKTSTNNLTTLE

SEQ ID NO: 1484 - protein, 16 aa, Human severe acute respiratory syndrome virus
DFSSYDIDNLSSCSTS

SEQ ID NO: 1485 - protein, 20 aa, Human severe acute respiratory syndrome virus
SKRYVVLLGSTTNLFTQLFR

SEQ ID NO: 1486 - protein, 10 aa, Human severe acute respiratory syndrome virus
RHVVFYIPDE

SEQ ID NO: 1487 - protein, 46 aa, Human severe acute respiratory syndrome virus
NIVTFCYLGIDMPCITVNTCAKISGRHVFNLIIGEHEIVTTVTCHF

SEQ ID NO: 1488 - protein, 4 aa, Human severe acute respiratory syndrome virus
VRVM

SEQ ID NO: 1489 - protein, 22 aa, Human severe acute respiratory syndrome virus
KFETFNNILCVNIGINNTLSGS

SEQ ID NO: 1490 - protein, 8 aa, Human severe acute respiratory syndrome virus
HECRKDTI

SEQ ID NO: 1491 - protein, 5 aa, Human severe acute respiratory syndrome virus
SYTLC

SEQ ID NO: 1492 - protein, 20 aa, Human severe acute respiratory syndrome virus
LAVSCSNKCLKFFHRNTKSC

SEQ ID NO: 1493 - protein, 20 aa, Human severe acute respiratory syndrome virus
KGVDISIKHLNGNFSTISNV

SEQ ID NO: 1494 - protein, 42 aa, Human severe acute respiratory syndrome virus
YKSLVKQQNRLAHQLTVVHRSRLRSRLVAFGLAIKNYDINRQ

SEQ ID NO: 1495 - protein, 10 aa, Human severe acute respiratory syndrome virus
TFSVVSSQIV

SEQ ID NO: 1496 - protein, 36 aa, Human severe acute respiratory syndrome virus
IDKMGERMSLIGLLTSLVKVEVKRAIFHSNTINNIR

SEQ ID NO: 1497 - protein, 12 aa, Human severe acute respiratory syndrome virus
LVSRVDWSFKLE

SEQ ID NO: 1498 - protein, 129 aa, Human severe acute respiratory syndrome virus
QITSNFITNECTTSAKCVTIETIPIVSLAEATASICIDIERSLHAINNSCTLNACGTIALIAHHASRRGATIHDMNIALPYVVERSKEDVHPNHCRNGCHLYNTNDKPHEPRIADEMTSKIAKEHLHYS

SEQ ID NO: 1499 - protein, 18 aa, Human severe acute respiratory syndrome virus
IKEFCEQHICQNPLSGQT

SEQ ID NO: 1500 - protein, 4 aa, Human severe acute respiratory syndrome virus
NCQV

SEQ ID NO: 1501 - protein, 16 aa, Human severe acute respiratory syndrome virus
NRHLNGFKSWIRIKGV

SEQ ID NO: 1502 - protein, 37 aa, Human severe acute respiratory syndrome virus
TNAARKRTFTEIHSSNVRRIKIQFSNAITIRRSTKIR

SEQ ID NO: 1503 - protein, 10 aa, Human severe acute respiratory syndrome virus
EYTKSSSYTD

SEQ ID NO: 1504 - protein, 12 aa, Human severe acute respiratory syndrome virus
PHSDCEQFRKFG

SEQ ID NO: 1505 - protein, 10 aa, Human severe acute respiratory syndrome virus
LHIINAGIQT

SEQ ID NO: 1506 - protein, 14 aa, Human severe acute respiratory syndrome virus
FSNTLNTIFSNSCR

SEQ ID NO: 1507 - protein, 17 aa, Human severe acute respiratory syndrome virus
SSNSRIGTFSKSTQLEQ

SEQ ID NO: 1508 - protein, 14 aa, Human severe acute respiratory syndrome virus
CKHIRHIIVKHTLC

SEQ ID NO: 1509 - protein, 5 aa, Human severe acute respiratory syndrome virus
SLSAI

SEQ ID NO: 1510 - protein, 7 aa, Human severe acute respiratory syndrome virus
CCNCCLS

SEQ ID NO: 1511 - protein, 26 aa, Human severe acute respiratory syndrome virus
EWFDISQNFTPRNTINCSNTMSGNCF

SEQ ID NO: 1512 - protein, 23 aa, Human severe acute respiratory syndrome virus
KLIRFLNGNACVFHISSHKILMT

SEQ ID NO: 1513 - protein, 9 aa, Human severe acute respiratory syndrome virus
LLCYFNTFI

SEQ ID NO: 1514 - protein, 55 aa, Human severe acute respiratory syndrome virus
WFKYDIAYNFGSFHVTLYDFLLYGRIFHYFFRGGLLTFTSKIVHSLCVFYCQNFK

SEQ ID NO: 1515 - protein, 11 aa, Human severe acute respiratory syndrome virus
SIYWLCTPKTT

SEQ ID NO: 1516 - protein, 24 aa, Human severe acute respiratory syndrome virus
TPSVWFERCLGCSLVNVPNNWLMQ

SEQ ID NO: 1517 - protein, 8 aa, Human severe acute respiratory syndrome virus
FSTFLETR

SEQ ID NO: 1518 - protein, 20 aa, Human severe acute respiratory syndrome virus
IVSIVNSHYIAIQVWEECDR

SEQ ID NO: 1519 - protein, 10 aa, Human severe acute respiratory syndrome virus
SWLCEACHLI

SEQ ID NO: 1520 - protein, 20 aa, Human severe acute respiratory syndrome virus
IISKFCVRTCEFEIIKTRIW

SEQ ID NO: 1521 - protein, 62 aa, Human severe acute respiratory syndrome virus
WLSWYKVYRLLCIVSIILFIIPIQFWFNLCVSNSIEFIRHRLDGCSVRCFLVENISHWSFVL

SEQ ID NO: 1522 - protein, 34 aa, Human severe acute respiratory syndrome virus
HLCKVSSVNTIEGLLSSYMSVMTTLIVTSVLIRT

SEQ ID NO: 1523 - protein, 5 aa, Human severe acute respiratory syndrome virus
ECTLL

SEQ ID NO: 1524 - protein, 18 aa, Human severe acute respiratory syndrome virus
FILSRWCRHHNKRRLLLY

SEQ ID NO: 1525 - protein, 22 aa, Human severe acute respiratory syndrome virus
ILCSITTTHTWNGNTCLKIIIR

SEQ ID NO: 1526 - protein, 11 aa, Human severe acute respiratory syndrome virus
STHIHHSFYTR

SEQ ID NO: 1527 - protein, 25 aa, Human severe acute respiratory syndrome virus
GSSFLTTMFTHHIKNSLCRFQISML

SEQ ID NO: 1528 - protein, 54 aa, Human severe acute respiratory syndrome virus
KMGHSFSDITKLANSFITVSEYECTKVSSITSTGSIISLLKCWCIEFDFKLLKC

SEQ ID NO: 1529 - protein, 13 aa, Human severe acute respiratory syndrome virus
NTRQITIVISPFN

SEQ ID NO: 1530 - protein, 13 aa, Human severe acute respiratory syndrome virus
TTNLRKFPFLCVV

SEQ ID NO: 1531 - protein, 22 aa, Human severe acute respiratory syndrome virus
SRHVPTKKTLIKSMVVLESFTT

SEQ ID NO: 1532 - protein, 5 aa, Human severe acute respiratory syndrome virus
CVITR

SEQ ID NO: 1533 - protein, 60 aa, Human severe acute respiratory syndrome virus
YKESLTLMIYMRFNFCNISTIQVCWTKLLSICHRHIHKLCVEISVVHSCEHFYSLNLPQG

SEQ ID NO: 1534 - protein, 29 aa, Human severe acute respiratory syndrome virus
KNLTVKMKLDGALQSVVHNFVTTLKKFNT

SEQ ID NO: 1535 - protein, 5 aa, Human severe acute respiratory syndrome virus
LCTLS

SEQ ID NO: 1536 - protein, 22 aa, Human severe acute respiratory syndrome virus
IGPISVRASQRNCFYKVLLRCL

SEQ ID NO: 1537 - protein, 13 aa, Human severe acute respiratory syndrome virus
RSEVSIICSNSIW

SEQ ID NO: 1538 - protein, 34 aa, Human severe acute respiratory syndrome virus
HYGRSFKRTHTARSLFKIKTMCHITNWHCDKRLI

SEQ ID NO: 1539 - protein, 52 aa, Human severe acute respiratory syndrome virus
RVQLRNNRSYRLFTSIKEESDTIVNDALLNFNSFILTLDGCHYGSNIHAYRH

SEQ ID NO: 1540 - protein, 19 aa, Human severe acute respiratory syndrome virus
FSCLFSMSKHFSQIPGYSS

SEQ ID NO: 1541 - protein, 9 aa, Human severe acute respiratory syndrome virus
NLFLSIRCF

SEQ ID NO: 1542 - protein, 41 aa, Human severe acute respiratory syndrome virus
YIKCRFAFLKSSLSFLKCITSTSLSRVRGYILINWHFLQSS

SEQ ID NO: 1543 - protein, 60 aa, Human severe acute respiratory syndrome virus
EHLSSATSLFGGYYNTSDITTSDNITYHVRCILLKERHIFTSKHVLRIMVKLTIDISKQE

SEQ ID NO: 1544 - protein, 88 aa, Human severe acute respiratory syndrome virus
LIGKKLSFFQCCGNLINAGLNFWLHIDRLLYDRFLLSFGIFCVWWLLLFRCFHSRLQVIKIIHDNLLIKSFVIDCNINLCTNRLHAHL

SEQ ID NO: 1545 - protein, 11 aa, Human severe acute respiratory syndrome virus
RLKWFSTKYAC

SEQ ID NO: 1546 - protein, 5 aa, Human severe acute respiratory syndrome virus
QQWCK

SEQ ID NO: 1547 - protein, 17 aa, Human severe acute respiratory syndrome virus
IEIFICCLKKLDVLTCI

SEQ ID NO: 1548 - protein, 28 aa, Human severe acute respiratory syndrome virus
VRSNNMQTLLSKIMSRKQTRPSYCKRAI

SEQ ID NO: 1549 - protein, 60 aa, Human severe acute respiratory syndrome virus
LNVIITLLLHGTIGCLVECTCYTTTMFQVYVSSIYNHHRISTLCLLNDVNTFNGNIVSKF

SEQ ID NO: 1550 - protein, 20 aa, Human severe acute respiratory syndrome virus
ITSKLINWFFRCRFWFWLNL

SEQ ID NO: 1551 - protein, 21 aa, Human severe acute respiratory syndrome virus
LLSSIIQPVFLFFFLNSNCFS

SEQ ID NO: 1552 - protein, 47 aa, Human severe acute respiratory syndrome virus
GTKFQRETLIIILCTVLMFTGFINFFFLTLCIVLFFLIWRVKGTIHT

SEQ ID NO: 1553 - protein, 9 aa, Human severe acute respiratory syndrome virus
KVFFTSIIK

SEQ ID NO: 1554 - protein, 23 aa, Human severe acute respiratory syndrome virus
VECSYTPLIKINTHVGKEIRNWL

SEQ ID NO: 1555 - protein, 68 aa, Human severe acute respiratory syndrome virus
SLHNSLCYNTCKLSNFGTGFNSVDRALFIKHFVNTFIKLKCDSHILVTLNFPNSIFSKGYTFNWCTPF

SEQ ID NO: 1556 - protein, 8 aa, Human severe acute respiratory syndrome virus
AKDIVCSQ

SEQ ID NO: 1557 - protein, 14 aa, Human severe acute respiratory syndrome virus
TRRQCAVLFFVLNL

SEQ ID NO: 1558 - protein, 44 aa, Human severe acute respiratory syndrome virus
EHEAIYTDWCANDSSICEAINGRLECFEFTVLENNLLRGKYCVM

SEQ ID NO: 1559 - protein, 16 aa, Human severe acute respiratory syndrome virus
ITFKKGYFFWCLKRHE

SEQ ID NO: 1560 - protein, 23 aa, Human severe acute respiratory syndrome virus
LQLLLATYTLTVKSLALSDEDFT

SEQ ID NO: 1561 - protein, 33 aa, Human severe acute respiratory syndrome virus
SQLCASDSDLINAHFECLVNNINEAFYTILDVI

SEQ ID NO: 1562 - protein, 79 aa, Human severe acute respiratory syndrome virus
SNLYLTLDDVKNTCNEKFENLPSILEKFNSCTKFRLNPFKDRPEFFNSSAQKIRQPLRSLLYKTTSYICHNNDTVGEQV

SEQ ID NO: 1563 - protein, 9 aa, Human severe acute respiratory syndrome virus
SINHGVDKT

SEQ ID NO: 1564 - protein, 18 aa, Human severe acute respiratory syndrome virus
LFRNTIKYGDSCSLQIRN

SEQ ID NO: 1565 - protein, 11 aa, Human severe acute respiratory syndrome virus
VVCCIKCARKN

SEQ ID NO: 1566 - protein, 7 aa, Human severe acute respiratory syndrome virus
SDNTSSL

SEQ ID NO: 1567 - protein, 7 aa, Human severe acute respiratory syndrome virus
GKTTQWC

SEQ ID NO: 1568 - protein, 94 aa, Human severe acute respiratory syndrome virus
SLLSNVPSTFYGLSLGNFIVTAGLNNGFERLVIKTLYSVNKGTCRSRERCQNDGNLFIQMKIANNVNVNTFTTQYLKEILIQGLHIVTSNASMA

SEQ ID NO: 1569 - protein, 41 aa, Human severe acute respiratory syndrome virus
ANISTSTRNPVGTLIIAANIGKHTASKTSSPTSLAESSFNV

SEQ ID NO: 1570 - protein, 30 aa, Human severe acute respiratory syndrome virus
VVVIICNTMLRSNLWVLTGRTWHFHYSISR

SEQ ID NO: 1571 - protein, 10 aa, Human severe acute respiratory syndrome virus
VPTCSRSFNN

SEQ ID NO: 1572 - protein, 18 aa, Human severe acute respiratory syndrome virus
IFSATMFTSGFQKVARLP

SEQ ID NO: 1573 - protein, 50 aa, Human severe acute respiratory syndrome virus
NFIAMITFHQGRQVHIVTLLWRCNRVHRAYTPHETLSLFLFNTWLNDFDF

SEQ ID NO: 1574 - protein, 67 aa, Human severe acute respiratory syndrome virus
VKRKHKLWAFPFESVKFLGTLNFEGCLVLVALIRALSEPGNFMLMVTAAVDTSLRLDVIKLFGKSAH

SEQ ID NO: 1575 - protein, 65 aa, Human severe acute respiratory syndrome virus
LARACEKIFDAIKRVPIWATEIVVDIASDCTSIELTSEFTECTTAMLSVPVLFIIFNGISAKLVT

SEQ ID NO: 1576 - protein, 4 aa, Human severe acute respiratory syndrome virus
VIRL

SEQ ID NO: 1577 - protein, 62 aa, Human severe acute respiratory syndrome virus
IDAIAMTTGSLITVLTKKNIAVCNWGFAHMWHEYSQCYTATTVLNAVHFCNQLNDLVAVIGA

SEQ ID NO: 1578 - protein, 23 aa, Human severe acute respiratory syndrome virus
GIRTFNEHIGLFKLGQYAFFQLY

SEQ ID NO: 1579 - protein, 13 aa, Human severe acute respiratory syndrome virus
TTSAIFEVFTCLR

SEQ ID NO: 1580 - protein, 11 aa, Human severe acute respiratory syndrome virus
GLFHRVPEATH

SEQ ID NO: 1581 - protein, 36 aa, Human severe acute respiratory syndrome virus
HVSNLKDRQTELDVCFLVDTKNKALHLTFRSHPDET

SEQ ID NO: 1582 - protein, 8 aa, Human severe acute respiratory syndrome virus
STATRTKP

SEQ ID NO: 1583 - protein, 58 aa, Human severe acute respiratory syndrome virus
AVCRRGTSYSFLVNDSKIYYCLYCVGALGMQPSDSYTDFKVRLENRSTRDRGWLAFPG

SEQ ID NO: 1584 - DNA, 29736 bp, Human severe acute respiratory syndrome virus; identical to SEQ ID NO: 1102
  CDS (2)..(29734)

SEQ ID NO: 1585 - protein, 11 aa, Human severe acute respiratory syndrome virus
FFFFFFFLSFS

SEQ ID NO: 1586 - protein, 8 aa, Human severe acute respiratory syndrome virus
EAIKITWG

SEQ ID NO: 1587 - protein, 13 aa, Human severe acute respiratory syndrome virus
FYTLGLFHIGSSP

SEQ ID NO: 1588 - protein, 14 aa, Human severe acute respiratory syndrome virus
HYSLYPRSYSAWPR

SEQ ID NO: 1589 - protein, 15 aa, Human severe acute respiratory syndrome virus
KCGGSFKSSLMLHID

SEQ ID NO: 1590 - protein, 9 aa, Human severe acute respiratory syndrome virus
RLLCEIKVN

SEQ ID NO: 1591 - protein, 15 aa, Human severe acute respiratory syndrome virus
TYLCCLVTRIHSAQE

SEQ ID NO: 1592 - protein, 26 aa, Human severe acute respiratory syndrome virus
TMYRKRNCENVYIAHLPCVVIMSVYA

SEQ ID NO: 1593 - protein, 11 aa, Human severe acute respiratory syndrome virus
VESAEAPLMEF

SEQ ID NO: 1594 - protein, 27 aa, Human severe acute respiratory syndrome virus
SCLEKSSMSAAGRRVTVGCFFCLCGKG

SEQ ID NO: 1595 - protein, 45 aa, Human severe acute respiratory syndrome virus
ASSVFFFLSFLGSVGGNVLYASMCLFSSMTLSLNCGSLSSNLMAP

SEQ ID NO: 1596 - protein, 34 aa, Human severe acute respiratory syndrome virus
VSHVPEGVTSMPMRDIPKNAEALGANCAICGQCL

SEQ ID NO: 1597 - protein, 25 aa, Human severe acute respiratory syndrome virus
SVPCLIRSWSPKFPWVCSGPRLPNA

SEQ ID NO: 1598 - protein, 90 aa, Human severe acute respiratory syndrome virus
VTLYCFVAVRFWRGFLDASAADFLVTVWPCCCWPLPETLLSSWFNLSSSNSARAVSPPPLAIRAGEFPLLLPGVEFLELPRLRDEEREEA

SEQ ID NO: 1599 - protein, 8 aa, Human severe acute respiratory syndrome virus
LPPLLPSA

SEQ ID NO: 1600 - protein, 8 aa, Human severe acute respiratory syndrome virus
KPFGNVVP

SEQ ID NO: 1601 - protein, 39 aa, Human severe acute respiratory syndrome virus
GSCSTVAALLLGLRVPMWSLGVFKAPSVATHTMPSLLAP

SEQ ID NO: 1602 - protein, 10 aa, Human severe acute respiratory syndrome virus
GSEASGPVPR

SEQ ID NO: 1603 - protein, 23 aa, Human severe acute respiratory syndrome virus
KYHLGLSSFILPSPPRTRRVALR

SEQ ID NO: 1604 - protein, 27 aa, Human severe acute respiratory syndrome virus
PIWSSGPLLVLIGTPWPRGNLSSSLPC

SEQ ID NO: 1605 - protein, 64 aa, Human severe acute respiratory syndrome virus
VRAVNQDAVLLGKPWGRRCFGLAPLRPPFWLLSVESVGPPNVMRGALRWFDWGPLSDILICSFI

SEQ ID NO: 1606 - protein, 50 aa, Human severe acute respiratory syndrome virus
NNKYVSKCSSLVTFMKVPTPSYKRTTSWILTVDSNIRCACLNHSVPSMKR

SEQ ID NO: 1607 - protein, 26 aa, Human severe acute respiratory syndrome virus
STKPSSAISITPSVVPYKDLQAHEVY

SEQ ID NO: 1608 - protein, 20 aa, Human severe acute respiratory syndrome virus
MHSAVLQCVCNCIEKYKSKQ

SEQ ID NO: 1609 - protein, 24 aa, Human severe acute respiratory syndrome virus
EVSCSFRLWYKVLLDPGFRVKTKI

SEQ ID NO: 1610 - protein, 20 aa, Human severe acute respiratory syndrome virus
ALLKQGIAERLKSTNRSQLK

SEQ ID NO: 1611 - protein, 14 aa, Human severe acute respiratory syndrome virus
AHSFCLSLNGEAKY

SEQ ID NO: 1612 - protein, 24 aa, Human severe acute respiratory syndrome virus
SSNNEKKWRVELLLNLLLSDEKFW

SEQ ID NO: 1613 - protein, 24 aa, Human severe acute respiratory syndrome virus
SCTQLIGMSSTVSTSKSKVCASAS

SEQ ID NO: 1614 - protein, 11 aa, Human severe acute respiratory syndrome virus
CKFIVSKRVKW

SEQ ID NO: 1615 - protein, 6 aa, Human severe acute respiratory syndrome virus
IALVCS

SEQ ID NO: 1616 - protein, 5 aa, Human severe acute respiratory syndrome virus
WARFF

SEQ ID NO: 1617 - protein, 12 aa, Human severe acute respiratory syndrome virus
YSRTSNTLLIVI

SEQ ID NO: 1618 - protein, 25 aa, Human severe acute respiratory syndrome virus
LARCKYNQCQEENNFHVRFMDNLTP

SEQ ID NO: 1619 - protein, 11 aa, Human severe acute respiratory syndrome virus
VLHHLTPNNSS

SEQ ID NO: 1620 - protein, 9 aa, Human severe acute respiratory syndrome virus
IIVSLLNLL

SEQ ID NO: 1621 - protein, 5 aa, Human severe acute respiratory syndrome virus
RQDSK

SEQ ID NO: 1622 - protein, 6 aa, Human severe acute respiratory syndrome virus
SISLLL

SEQ ID NO: 1623 - protein, 31 aa, Human severe acute respiratory syndrome virus
PGSQQDETSVVTYCTSKAILSLLPAWSVFNL

SEQ ID NO: 1624 - protein, 4 aa, Human severe acute respiratory syndrome virus
FPIR

SEQ ID NO: 1625 - protein, 19 aa, Human severe acute respiratory syndrome virus
RLYAAKPESVPTRCDAPNL

SEQ ID NO: 1626 - protein, 29 aa, Human severe acute respiratory syndrome virus
ESVRDVATVISFGRSLMSQRPRECPAIRK

SEQ ID NO: 1627 - protein, 52 aa, Human severe acute respiratory syndrome virus
PRMITAPMTSSLSMSGLVTIVPRRGTLRRMFVSGLNDHIERVRANSLKEATK

SEQ ID NO: 1628 - protein, 23 aa, Human severe acute respiratory syndrome virus
LSHIKPTIQAIAIAIPPVTQLIL

SEQ ID NO: 1629 - protein, 31 aa, Human severe acute respiratory syndrome virus
TAASTKQASVTGHKSQRKTSFIMYKNLFRLE

SEQ ID NO: 1630 - protein, 68 aa, Human severe acute respiratory syndrome virus
ANCSNIIQARNRKPITRFHCSRSCLSSSTVIVPLSAMISNVKVPNRIIIIVSSFRPEDQELLQKSSDF

SEQ ID NO: 1631 - protein, 14 aa, Human severe acute respiratory syndrome virus
HASRRKPLVLLNSR

SEQ ID NO: 1632 - protein, 12 aa, Human severe acute respiratory syndrome virus
QYCSSTHTIEAQ

SEQ ID NO: 1633 - protein, 4 aa, Human severe acute respiratory syndrome virus
GWLV

SEQ ID NO: 1634 - protein, 14 aa, Human severe acute respiratory syndrome virus
LARIPRKQEKEVRY

SEQ ID NO: 1635 - protein, 13 aa, Human severe acute respiratory syndrome virus
LLTYLFLPKRMST

SEQ ID NO: 1636 - protein, 12 aa, Human severe acute respiratory syndrome virus
VRTHFLVLTKAR

SEQ ID NO: 1637 - protein, 13 aa, Human severe acute respiratory syndrome virus
SSSAHHKLDPLLD

SEQ ID NO: 1638 - protein, 17 aa, Human severe acute respiratory syndrome virus
QLLKSRRLCVFAHSVGL

SEQ ID NO: 1639 - protein, 7 aa, Human severe acute respiratory syndrome virus
HFQYQCL

SEQ ID NO: 1640 - protein, 8 aa, Human severe acute respiratory syndrome virus
TQAGSKLR

SEQ ID NO: 1641 - protein, 9 aa, Human severe acute respiratory syndrome virus
NSHVQRHSL

SEQ ID NO: 1642 - protein, 16 aa, Human severe acute respiratory syndrome virus
HLSAYPQNNHQFGSLL

SEQ ID NO: 1643 - protein, 10 aa, Human severe acute respiratory syndrome virus
VLVLKCRHLQ

SEQ ID NO: 1644 - protein, 5 aa, Human severe acute respiratory syndrome virus
RQLYL

SEQ ID NO: 1645 - protein, 38 aa, Human severe acute respiratory syndrome virus
HCYMVYSSHSYVCASKQSSWHHKVMGSWICTSNKANIS

SEQ ID NO: 1646 - protein, 4 aa, Human severe acute respiratory syndrome virus
FYMR

SEQ ID NO: 1647 - protein, 29 aa, Human severe acute respiratory syndrome virus
CIVENISRHRGTKIAPPYLQRQAKDVNRW

SEQ ID NO: 1648 - protein, 8 aa, Human severe acute respiratory syndrome virus
QIAAVNCK

SEQ ID NO: 1649 - protein, 13 aa, Human severe acute respiratory syndrome virus
TGSPYKGLAAIFY

SEQ ID NO: 1650 - protein, 5 aa, Human severe acute respiratory syndrome virus
AQLFW

SEQ ID NO: 1651 - protein, 11 aa, Human severe acute respiratory syndrome virus
RSEKQQEMQRQ

SEQ ID NO: 1652 - protein, 15 aa, Human severe acute respiratory syndrome virus
QAIRKGVRLVAVSLL

SEQ ID NO: 1653 - protein, 17 aa, Human severe acute respiratory syndrome virus
HEQYLQEKHCQFLLAVQ

SEQ ID NO: 1654 - protein, 4 aa, Human severe acute respiratory syndrome virus
LIQE

SEQ ID NO: 1655 - protein, 6 aa, Human severe acute respiratory syndrome virus
VRLCVM

SEQ ID NO: 1656 - protein, 45 aa, Human severe acute respiratory syndrome virus
FDTLENWLRVILIKLAARTTRACTLEATATTSHATKQDCNHDDGN

SEQ ID NO: 1657 - protein, 27 aa, Human severe acute respiratory syndrome virus
SSNEAEPNIPRPFNILLIFSQFLKVNE

SEQ ID NO: 1658 - protein, 22 aa, Human severe acute respiratory syndrome virus
IFSDLIEAVNFFLNVDDRSVNA

SEQ ID NO: 1659 - protein, 8 aa, Human severe acute respiratory syndrome virus
NVAKINIW

SEQ ID NO: 1660 - protein, 13 aa, Human severe acute respiratory syndrome virus
CMIFEVLVQLFFE

SEQ ID NO: 1661 - protein, 23 aa, Human severe acute respiratory syndrome virus
VKLRLQRIINCVVNDANNDITIS

SEQ ID NO: 1662 - protein, 59 aa, Human severe acute respiratory syndrome virus
DKCIVCSNYLWRKEVPLCNKPRSAIKHKNTFTREVCFAFMTNCWRCGEVPLLGWHIRDM

SEQ ID NO: 1663 - protein, 25 aa, Human severe acute respiratory syndrome virus
EDNTMRGCLWEGHKVVALSTKVNSF

SEQ ID NO: 1664 - protein, 24 aa, Human severe acute respiratory syndrome virus
LSKNTLRHFSSSKISRSPDFSSPD

SEQ ID NO: 1665 - protein, 15 aa, Human severe acute respiratory syndrome virus
LLCYIGLKALKSACN

SEQ ID NO: 1666 - protein, 18 aa, Human severe acute respiratory syndrome virus
PVNLYLRLDFIKSRKDII

SEQ ID NO: 1667 - protein, 14 aa, Human severe acute respiratory syndrome virus
NCTKIRAKLFNKCV

SEQ ID NO: 1668 - protein, 16 aa, Human severe acute respiratory syndrome virus
CLSILVNNVLQLAQCS

SEQ ID NO: 1669 - protein, 4 aa, Human severe acute respiratory syndrome virus
CCCK

SEQ ID NO: 1670 - protein, 59 aa, Human severe acute respiratory syndrome virus
FLNLTNRLVKLVGDLFLVLIENILGNSNAIEPICHLHSKRYLKSSASTKCPSSSGSTTN

SEQ ID NO: 1671 - protein, 35 aa, Human severe acute respiratory syndrome virus
SSSVGSNHIISEQRWQHCKSIELLRTNEISSINIT

SEQ ID NO: 1672 - protein, 30 aa, Human severe acute respiratory syndrome virus
AFAILLHEASISECHLIKEQVLNKRPLSWL

SEQ ID NO: 1673 - protein, 34 aa, Human severe acute respiratory syndrome virus
KIKTTKIFQSWGFVHLFDLSEHFTCVAILFSSNT

SEQ ID NO: 1674 - protein, 4 aa, Human severe acute respiratory syndrome virus
ECTI

SEQ ID NO: 1675 - protein, 43 aa, Human severe acute respiratory syndrome virus
LCAKATILEKQISTFSRISADVHITIYGGFSHRNRHYFCSNAN

SEQ ID NO: 1676 - protein, 14 aa, Human severe acute respiratory syndrome virus
KVSRYSNGVIRVSN

SEQ ID NO: 1677 - protein, 4 aa, Human severe acute respiratory syndrome virus
TIST

SEQ ID NO: 1678 - protein, 14 aa, Human severe acute respiratory syndrome virus
RHSISHNRFLASTT

SEQ ID NO: 1679 - protein, 67 aa, Human severe acute respiratory syndrome virus
RNCMVTSTNASSNRNVALIRSVDMLSSYKTACLSLEYIVSSRIYAPSWCELICMNCCRNISAVNILI

SEQ ID NO: 1680 - protein, 5 aa, Human severe acute respiratory syndrome virus
NSNFR

SEQ ID NO: 1681 - protein, 16 aa, Human severe acute respiratory syndrome virus
SICSRCNYTYTPKRAR

SEQ ID NO: 1682 - protein, 28 aa, Human severe acute respiratory syndrome virus
YFRCFRISNGISEIRNITAKLLKWLKSL

SEQ ID NO: 1683 - protein, 22 aa, Human severe acute respiratory syndrome virus
HTSTSESIKIKIDTLVLNKVSG

SEQ ID NO: 1684 - protein, 10 aa, Human severe acute respiratory syndrome virus
FWSTNRGRCI

SEQ ID NO: 1685 - protein, 25 aa, Human severe acute respiratory syndrome virus
KFKRKYYNSVRLVANASSGVKTIII

SEQ ID NO: 1686 - protein, 45 aa, Human severe acute respiratory syndrome virus
WPITIKSRWGARFAIRGERHIRYVSLKGPKLAMSKIPIFIIIITS

SEQ ID NO: 1687 - protein, 69 aa, Human severe acute respiratory syndrome virus
SSINVPSIPSKDTTHEIIWQFIIIISNNTSLSWRYLSYIISLDYKRICIDIGEAKIIQLSGRNAIALKG

SEQ ID NO: 1688 - protein, 47 aa, Human severe acute respiratory syndrome virus
VVEHRVISNTIRNFFSLPCIDRREFSSIKNLSKRTQVCNIRESHNIS

SEQ ID NO: 1689 - protein, 52 aa, Human severe acute respiratory syndrome virus
GNNPEIRGLVNSFVNLKALNRAFEFSKWILRTINSICDCTIFIILEHKCSWL

SEQ ID NO: 1690 - protein, 8 aa, Human severe acute respiratory syndrome virus
IANKIGCS

SEQ ID NO: 1691 - protein, 8 aa, Human severe acute respiratory syndrome virus
RAPSVLSR

SEQ ID NO: 1692 - protein, 29 aa, Human severe acute respiratory syndrome virus
KGCKNGSKICNVNTKRQLKNRFQSVKTRR

SEQ ID NO: 1693 - protein, 26 aa, Human severe acute respiratory syndrome virus
ITNYIYRLIALINIEKPIFIFKHKLS

SEQ ID NO: 1694 - protein, 5 aa, Human severe acute respiratory syndrome virus
VFKIT

SEQ ID NO: 1695 - protein, 61 aa, Human severe acute respiratory syndrome virus
NIKRKGIRYVLESAIKCIIEYHSMCLCTHGFRNSKERVVTQFKVTCSYNNISRIVNNNHRL

SEQ ID NO: 1696 - protein, 15 aa, Human severe acute respiratory syndrome virus
LVVHGRTKNPTTDNI

SEQ ID NO: 1697 - protein, 36 aa, Human severe acute respiratory syndrome virus
FLCGSKINTILKRYDRVVKRMINSMKPCNIRIKWKK

SEQ ID NO: 1698 - protein, 4 aa, Human severe acute respiratory syndrome virus
IKSV

SEQ ID NO: 1699 - protein, 13 aa, Human severe acute respiratory syndrome virus
SKNFIRIVNPPHR

SEQ ID NO: 1700 - protein, 28 aa, Human severe acute respiratory syndrome virus
SMLSVIRSLNIIKSGAPVKVTTTSESKK

SEQ ID NO: 1701 - protein, 14 aa, Human severe acute respiratory syndrome virus
ENKHVRLVVNKNIT

SEQ ID NO: 1702 - protein, 36 aa, Human severe acute respiratory syndrome virus
NHNSVVFSNDKPTFFQKRINHIIDLILLKRHYSSSS

SEQ ID NO: 1703 - protein, 10 aa, Human severe acute respiratory syndrome virus
FKRKFAHVKE

SEQ ID NO: 1704 - protein, 36 aa, Human severe acute respiratory syndrome virus
IGRQLDRICVPPENVVSMHGIAINLFLRLAKIVSPN

SEQ ID NO: 1705 - protein, 4 aa, Human severe acute respiratory syndrome virus
KCFR

SEQ ID NO: 1706 - protein, 11 aa, Human severe acute respiratory syndrome virus
CIYICNKSCPP

SEQ ID NO: 1707 - protein, 26 aa, Human severe acute respiratory syndrome virus
EMAHKLVKVSIPRMLCYLYSYRTTQG

SEQ ID NO: 1708 - protein, 49 aa, Human severe acute respiratory syndrome virus
FLLYKSTQISEKPFFRVILFCHMFGPRVIHIANNKVPFISRMYCCTVSN

SEQ ID NO: 1709 - protein, 12 aa, Human severe acute respiratory syndrome virus
SRICVGDEVIKI

SEQ ID NO: 1710 - protein, 34 aa, Human severe acute respiratory syndrome virus
CASWQPLSEHSCTWCNSFIRASTKVNNSHVVGYS

SEQ ID NO: 1711 - protein, 4 aa, Human severe acute respiratory syndrome virus
SKCI

SEQ ID NO: 1712 - protein, 54 aa, Human severe acute respiratory syndrome virus
VLTQLSILCDIHHYSFWYNSIFTIILKVTLFKKHSLHLVQVRHRNTWLPRLTCL

SEQ ID NO: 1713 - protein, 16 aa, Human severe acute respiratory syndrome virus
FWVEGFNMSILTPKHE

SEQ ID NO: 1714 - protein, 12 aa, Human severe acute respiratory syndrome virus
NFSIVNCNLDHF

SEQ ID NO: 1715 - protein, 9 aa, Human severe acute respiratory syndrome virus
LYYLDKVIK

SEQ ID NO: 1716 - protein, 9 aa, Human severe acute respiratory syndrome virus
KINHRTHTF

SEQ ID NO: 1717 - protein, 21 aa, Human severe acute respiratory syndrome virus
TCLRICYEVIFHCAVHRDKIL

SEQ ID NO: 1718 - protein, 42 aa, Human severe acute respiratory syndrome virus
MKTAKLSMTEISINDVFEGIALELISLYEFIHSELEKVSFHL

SEQ ID NO: 1719 - protein, 6 aa, Human severe acute respiratory syndrome virus
SGLKIL

SEQ ID NO: 1720 - protein, 28 aa, Human severe acute respiratory syndrome virus
VSALSKVGFRQLLNNAVYFLKVVKLCFY

SEQ ID NO: 1721 - protein, 12 aa, Human severe acute respiratory syndrome virus
CDSIDASLCWSL

SEQ ID NO: 1722 - protein, 4 aa, Human severe acute respiratory syndrome virus
TFCY

SEQ ID NO: 1723 - protein, 23 aa, Human severe acute respiratory syndrome virus
NTITGVSKKVYLSFHSTIKQDSK

SEQ ID NO: 1724 - protein, 115 aa, Human severe acute respiratory syndrome virus
RTSTLSRFLGNVSHCADTYCRYMCWGFSFVVPDYSISSDINTQIIEYLNLWHWFNVTLSPKLKCNINRKCCLIFKDLHINTIYLCVNSIINDGNRCFAGVSIKVSFINNIISHIF

SEQ ID NO: 1725 - protein, 17 aa, Human severe acute respiratory syndrome virus
PGKCIPQVISIKLFVNP

SEQ ID NO: 1726 - protein, 28 aa, Human severe acute respiratory syndrome virus
AKSSRNHHIICIQVLSVLICMVSANSTT

SEQ ID NO: 1727 - protein, 39 aa, Human severe acute respiratory syndrome virus
IASCNTRSRFEWNIINIRHYLFAMRLTRTIRIVKERQLL

SEQ ID NO: 1728 - protein, 27 aa, Human severe acute respiratory syndrome virus
ISKCTFIESWSVECMLIHIQTTTITAW

SEQ ID NO: 1729 - protein, 126 aa, Human severe acute respiratory syndrome virus
QDSCVKPTHNCIGWVTINVTIPKQTNTISEFIVMCSIRIEELLYFVSFVTTWLSIVELPFYFSLRHTLDSLWISNVMKNWKLISKQCRLHNHVLYFSASRINPQFISYNRVFNRPINALNKALMDC

SEQ ID NO: 1730 - protein, 58 aa, Human severe acute respiratory syndrome virus
TSSHDSITTSHMCISMYLAMLVMVTLKVTRKAPLLNINHKWVIDIVKTHRMIPAGISI

SEQ ID NO: 1731 - protein, 25 aa, Human severe acute respiratory syndrome virus
SRKASCTFVTQTTRSFRSNLDKVLH

SEQ ID NO: 1732 - protein, 15 aa, Human severe acute respiratory syndrome virus
CKLKAMRPKDEHDSV

SEQ ID NO: 1733 - protein, 60 aa, Human severe acute respiratory syndrome virus
QSFQCITEHLYYLNTHYIPGQAFIHEWYKMFKLVTWWRFCINSGEFCVIFSVNITSRYSY

SEQ ID NO: 1734 - protein, 7 aa, Human severe acute respiratory syndrome virus
VNTCRKS

SEQ ID NO: 1735 - protein, 66 aa, Human severe acute respiratory syndrome virus
VSTHSISSCMTALYIKANPRTNVTNSFFAGDKHIRVTIDLVIHFETHHRDESTVGHVLWYAWYVNT

SEQ ID NO: 1736 - protein, 38 aa, Human severe acute respiratory syndrome virus
SFSLELYINAEVCRCLCRMKTSNDLTTVLKKSSYIFCL

SEQ ID NO: 1737 - protein, 9 aa, Human severe acute respiratory syndrome virus
CSHIATWYF

SEQ ID NO: 1738 - protein, 53 aa, Human severe acute respiratory syndrome virus
TCKLQFVIKISIRHYAQNANFCPCDSHIETVDITRVCCFSSLCEYDIVIFRTL

SEQ ID NO: 1739 - protein, 8 aa, Human severe acute respiratory syndrome virus
INSLRRQS

SEQ ID NO: 1740 - protein, 5 aa, Human severe acute respiratory syndrome virus
SYSVL

SEQ ID NO: 1741 - protein, 27 aa, Human severe acute respiratory syndrome virus
DKNSFSPSRIACKKFSYNAYLRSVDCR

SEQ ID NO: 1742 - protein, 16 aa, Human severe acute respiratory syndrome virus
NIMCNNTFVEHFEALS

SEQ ID NO: 1743 - protein, 6 aa, Human severe acute respiratory syndrome virus
LLLVCF

SEQ ID NO: 1744 - protein, 5 aa, Human severe acute respiratory syndrome virus
LIVIN

SEQ ID NO: 1745 - protein, 30 aa, Human severe acute respiratory syndrome virus
STHSVNNFSRTTATSSKEHVWTYCFHKSAH

SEQ ID NO: 1746 - protein, 6 aa, Human severe acute respiratory syndrome virus
IKIFWF

SEQ ID NO: 1747 - protein, 11 aa, Human severe acute respiratory syndrome virus
CAFSQQCAGGW

SEQ ID NO: 1748 - protein, 52 aa, Human severe acute respiratory syndrome virus
LSRIANIDVVFCTKSSIDNTQVIISSHRDFIKDYNVSSCFWQCIYSAENILF

SEQ ID NO: 1749 - protein, 27 aa, Human severe acute respiratory syndrome virus
IHFEFIKTLYARTRRYDSTTFIYGQIF

SEQ ID NO: 1750 - protein, 4 aa, Human severe acute respiratory syndrome virus
CLFT

SEQ ID NO: 1751 - protein, 57 aa, Human severe acute respiratory syndrome virus
GINSCMRACRIHYASRWVIESKSDGKMTLTSTRWSLECRVLLHADLLIICNIARKLI

SEQ ID NO: 1752 - protein, 18 aa, Human severe acute respiratory syndrome virus
DVECWVQASNSHIVLLWH

SEQ ID NO: 1753 - protein, 73 aa, Human severe acute respiratory syndrome virus
SRCTKWHYSVRCQHKVITNIQLVCRSTSVHNSITIVTFFKGVLSNLYFTIFSYTVTSKDIVSVQWWSRFSNLP

SEQ ID NO: 1754 - protein, 17 aa, Human severe acute respiratory syndrome virus
KMQFSVREYFAYSGNTI

SEQ ID NO: 1755 - protein, 55 aa, Human severe acute respiratory syndrome virus
QLKCFLSGFERFCCEKLESLSTSVGKYVIASISPITCCYRIEVSDIVTAYTCVFV

SEQ ID NO: 1756 - protein, 8 aa, Human severe acute respiratory syndrome virus
TKNLTIST

SEQ ID NO: 1757 - protein, 8 aa, Human severe acute respiratory syndrome virus
WKTNGRLM

SEQ ID NO: 1758 - protein, 8 aa, Human severe acute respiratory syndrome virus
LAIIAHTS

SEQ ID NO: 1759 - protein, 23 aa, Human severe acute respiratory syndrome virus
IQLCHISDITTWGIANIGINRQH

SEQ ID NO: 1760 - protein, 10 aa, Human severe acute respiratory syndrome virus
NDMVIAALAT

SEQ ID NO: 1761 - protein, 11 aa, Human severe acute respiratory syndrome virus
EWSPNTGTATK

SEQ ID NO: 1762 - protein, 28 aa, Human severe acute respiratory syndrome virus
IAQYTSTYSLQDCMWCVHSLIKLRFPVP

SEQ ID NO: 1763 - protein, 5 aa, Human severe acute respiratory syndrome virus
GVIIS

SEQ ID NO: 1764 - protein, 15 aa, Human severe acute respiratory syndrome virus
HYGIHVQHVASKLIM

SEQ ID NO: 1765 - protein, 5 aa, Human severe acute respiratory syndrome virus
LSNVL

SEQ ID NO: 1766 - protein, 23 aa, Human severe acute respiratory syndrome virus
IQVKDISILLIRMFCKWVSINSQ

SEQ ID NO: 1767 - protein, 22 aa, Human severe acute respiratory syndrome virus
HEPFNHKCTICFDNIIDKTACA

SEQ ID NO: 1768 - protein, 15 aa, Human severe acute respiratory syndrome virus
WIWVRQVHVIISLFN

SEQ ID NO: 1769 - protein, 4 aa, Human severe acute respiratory syndrome virus
HCML

SEQ ID NO: 1770 - protein, 38 aa, Human severe acute respiratory syndrome virus
AKFVRSFSKVSLSPTFCLRHEHIILIIKNCLKVLNASY

SEQ ID NO: 1771 - protein, 51 aa, Human severe acute respiratory syndrome virus
TLSRIVTVIAHNGIIRKNHHGEMFTQVSVKLIHEFMINIPISIETLIEPVL

SEQ ID NO: 1772 - protein, 13 aa, Human severe acute respiratory syndrome virus
IADILVSYLITIS

SEQ ID NO: 1773 - protein, 27 aa, Human severe acute respiratory syndrome virus
KKCIYIGCNSLTNVKDTISISSCSITG

SEQ ID NO: 1774 - protein, 7 aa, Human severe acute respiratory syndrome virus
CSTWFNI

SEQ ID NO: 1775 - protein, 8 aa, Human severe acute respiratory syndrome virus
AATHDHLT

SEQ ID NO: 1776 - protein, 7 aa, Human severe acute respiratory syndrome virus
YLRTLVS

SEQ ID NO: 1777 - protein, 5 aa, Human severe acute respiratory syndrome virus
PVETV

SEQ ID NO: 1778 - protein, 45 aa, Human severe acute respiratory syndrome virus
VTASVMFASKNKRGHYPKHVRHGSVTFWIIPTHKVWSFYITVNSF

SEQ ID NO: 1779 - protein, 23 aa, Human severe acute respiratory syndrome virus
HIMPATVKLACSNYHSSSSSGGY

SEQ ID NO: 1780 - protein, 56 aa, Human severe acute respiratory syndrome virus
FLMKLSICHSTTDRDTSYGASSILCTNGILKIHLSYSRDDITLSIREKCILILITH

SEQ ID NO: 1781 - protein, 16 aa, Human severe acute respiratory syndrome virus
VIIKSSLTPFIKWETS

SEQ ID NO: 1782 - protein, 30 aa, Human severe acute respiratory syndrome virus
FIQIVNDYLVGINTATIVTIKVFINNFNYE

SEQ ID NO: 1783 - protein, 32 aa, Human severe acute respiratory syndrome virus
ELSDITHCWQIITIIVIITDSSVAILSKEEVF

SEQ ID NO: 1784 - protein, 35 aa, Human severe acute respiratory syndrome virus
FNRTSFLKETFRHSKVIKVFIKITGFDSLKSNIVC

SEQ ID NO: 1785 - protein, 7 aa, Human severe acute respiratory syndrome virus
KACSAFI

SEQ ID NO: 1786 - protein, 14 aa, Human severe acute respiratory syndrome virus
IARSCMHSWISSIH

SEQ ID NO: 1787 - protein, 10 aa, Human severe acute respiratory syndrome virus
KFLETETRAM

SEQ ID NO: 1788 - protein, 9 aa, Human severe acute respiratory syndrome virus
VYILIMYDS

SEQ ID NO: 1789 - protein, 7 aa, Human severe acute respiratory syndrome virus
LTKMVSS

SEQ ID NO: 1790 - protein, 13 aa, Human severe acute respiratory syndrome virus
NNKRNTIYKYFSY

SEQ ID NO: 1791 - protein, 12 aa, Human severe acute respiratory syndrome virus
WSKTCRWKHSRK

SEQ ID NO: 1792 - protein, 76 aa, Human severe acute respiratory syndrome virus
HIKVCTMKDTPIIQTVNTIGMVCLVPIFKITVEETKSLFRKIIFQQIPLNKWFCEISIHMGLSSQCPSQSEDGHQQ

SEQ ID NO: 1793 - protein, 28 aa, Human severe acute respiratory syndrome virus
IHNRNSAAWCYLYEITEIVPVPIKILII

SEQ ID NO: 1794 - protein, 19 aa, Human severe acute respiratory syndrome virus
CQYAYNACITHSIAELYSL

SEQ ID NO: 1795 - protein, 6 aa, Human severe acute respiratory syndrome virus
LAYTLT

SEQ ID NO: 1796 - protein, 5 aa, Human severe acute respiratory syndrome virus
VSIYA

SEQ ID NO: 1797 - protein, 29 aa, Human severe acute respiratory syndrome virus
DVRILYEVIPILLIEIIIITAIVCDEYFF

SEQ ID NO: 1798 - protein, 10 aa, Human severe acute respiratory syndrome virus
CITITLIKMT

SEQ ID NO: 1799 - protein, 7 aa, Human severe acute respiratory syndrome virus
ISHCVFS

SEQ ID NO: 1800 - protein, 48 aa, Human severe acute respiratory syndrome virus
YMWYHVTIYSKLEKVMDSNRWTIFNQVINSLFMLVVRHSMPLNYKVRV

SEQ ID NO: 1801 - protein, 15 aa, Human severe acute respiratory syndrome virus
IAFLILLLEATAISF

SEQ ID NO: 1802 - protein, 61 aa, Human severe acute respiratory syndrome virus
ELCKTSNFFVVNIKSPVDDISTSACAARCKTGCTYTANPFKNVDASADCIKGSRSWSQLQP

SEQ ID NO: 1803 - protein, 95 aa, Human severe acute respiratory syndrome virus
PFHIPQTVQTVFLSVKPTGSLAQVVGIWTYLPFKSQNPLGFGWSMWHLQYRQHEAPPKDSWSMLASGVTVIACPVPVCVHNIFTQLVIGCPPLAR

SEQ ID NO: 1804 - protein, 29 aa, Human severe acute respiratory syndrome virus
SLYALAGSTAKAQKESTVELAGTSVAFPA

SEQ ID NO: 1805 - protein, 46 aa, Human severe acute respiratory syndrome virus
RRTVAAKLPSTIPLFRLFKPLMKYKYFTLGPFGVSVTNLQGGSSSV

SEQ ID NO: 1806 - protein, 33 aa, Human severe acute respiratory syndrome virus
IVPVPSLLGNLAHLRSWWSDSNASTNLPPFELL

SEQ ID NO: 1807 - protein, 60 aa, Human severe acute respiratory syndrome virus
ASALSSVQAVCVVPAAQDICRSATGLSSLFCSLTAELALRAVTIRGQAKFGELSMLISLS

SEQ ID NO: 1808 - protein, 29 aa, Human severe acute respiratory syndrome virus
TILLSASTTCWISQSADAYVKVLPSQVFL

SEQ ID NO: 1809 - protein, 69 aa, Human severe acute respiratory syndrome virus
SGTTTMSLAAVVNGMMLSGTQPSRALLIMLLSASLSSFLSIVKSIVCIALVTFALLSSDLACLYIWVIA

SEQ ID NO: 1810 - protein, 42 aa, Human severe acute respiratory syndrome virus
SAIFSNLRCMAASRSNSDLATFKDFFNFLRTTSESPLATACS

SEQ ID NO: 1811 - protein, 6 aa, Human severe acute respiratory syndrome virus
ASWAVA

SEQ ID NO: 1812 - protein, 14 aa, Human severe acute respiratory syndrome virus
AAYDGKELNSEAIA

SEQ ID NO: 1813 - protein, 64 aa, Human severe acute respiratory syndrome virus
RVARLSSISSHNLLMSTAPCMDSKTDKRETIFSKASVVSFARRISLWSCTHCAHNLEDDSTLSC

SEQ ID NO: 1814 - protein, 63 aa, Human severe acute respiratory syndrome virus
RTESSTTDVHFTSDILDCTVATLIHGLPPIPNNLMLSLKASILLLGGKSPWEFIYLNSCVETK

SEQ ID NO: 1815 - protein, 7 aa, Human severe acute respiratory syndrome virus
TPRVSLK

SEQ ID NO: 1816 - protein, 9 aa, Human severe acute respiratory syndrome virus
RLSKQKRPK

SEQ ID NO: 1817 - protein, 4 aa, Human severe acute respiratory syndrome virus
QQQQ

SEQ ID NO: 1818 - protein, 4 aa, Human severe acute respiratory syndrome virus
PKKQ

SEQ ID NO: 1819 - protein, 16 aa, Human severe acute respiratory syndrome virus
TSMIHCKVLPVINNNG

SEQ ID NO: 1820 - protein, 21 aa, Human severe acute respiratory syndrome virus
YSTHTNTIALAKNMIVVTTPE

SEQ ID NO: 1821 - protein, 14 aa, Human severe acute respiratory syndrome virus
LEVTEITKAHMEIA

SEQ ID NO: 1822 - protein, 5 aa, Human severe acute respiratory syndrome virus
SKALP

SEQ ID NO: 1823 - protein, 17 aa, Human severe acute respiratory syndrome virus
TSVMTFISVQTRLAASS

SEQ ID NO: 1824 - protein, 23 aa, Human severe acute respiratory syndrome virus
TVRAVMRISKTKAEAYITQSLSL

SEQ ID NO: 1825 - protein, 22 aa, Human severe acute respiratory syndrome virus
PDKLVSANSSHVMIRITQLAGM

SEQ ID NO: 1826 - protein, 4 aa, Human severe acute respiratory syndrome virus
TILK

SEQ ID NO: 1827 - protein, 41 aa, Human severe acute respiratory syndrome virus
ATVAREGNRNKHKNACLCLTSSIAHAAIAIIPRVNGKKAFS

SEQ ID NO: 1828 - protein, 10 aa, Human severe acute respiratory syndrome virus
TKKNSDHCVL

SEQ ID NO: 1829 - protein, 14 aa, Human severe acute respiratory syndrome virus
TRINSDVKKVKSIQ

SEQ ID NO: 1830 - protein, 60 aa, Human severe acute respiratory syndrome virus
VPLTIFLNLPWKVTPEHCLTTSNGVNSSSKIVLPRIVRPFIPFCSSSFKAAHISKTAIPV

SEQ ID NO: 1831 - protein, 9 aa, Human severe acute respiratory syndrome virus
AERGPNMST

SEQ ID NO: 1832 - protein, 6 aa, Human severe acute respiratory syndrome virus
SCVKGS

SEQ ID NO: 1833 - protein, 56 aa, Human severe acute respiratory syndrome virus
LYFIATRLKSFKVVVNLLRNHLSPLITAAYSHAKTFNVMVVSVPAACAVCLSTNGP

SEQ ID NO: 1834 - protein, 17 aa, Human severe acute respiratory syndrome virus
NLPSKSVPACTPVGSSI

SEQ ID NO: 1835 - protein, 6 aa, Human severe acute respiratory syndrome virus
QKDTQS

SEQ ID NO: 1836 - protein, 19 aa, Human severe acute respiratory syndrome virus
SMLKPTLPHDPLRKEPLMV

SEQ ID NO: 1837 - protein, 6 aa, Human severe acute respiratory syndrome virus
LGLMAH

SEQ ID NO: 1838 - protein, 7 aa, Human severe acute respiratory syndrome virus
TPDGEPL

SEQ ID NO: 1839 - protein, 7 aa, Human severe acute respiratory syndrome virus
HARTENV

SEQ ID NO: 1840 - protein, 35 aa, Human severe acute respiratory syndrome virus
PGWIRTNLYLGVLGLEVSTLSLSRQFCIEWPITRS

SEQ ID NO: 1841 - protein, 4 aa, Human severe acute respiratory syndrome virus
TLPA

SEQ ID NO: 1842 - protein, 14 aa, Human severe acute respiratory syndrome virus
TRKLWLDLRMSRSS

SEQ ID NO: 1843 - protein, 66 aa, Human severe acute respiratory syndrome virus
LGLSMSSAVQMTCLGQYTVSSNHNPLRVVVPQVTCTMHPSTLPDGNAIFLKPLCRTAEVIDVCGGW

SEQ ID NO: 1844 - protein, 23 aa, Human severe acute respiratory syndrome virus
RTSAPELLKSFRAFAKWQQAASR

SEQ ID NO: 1845 - protein, 65 aa, Human severe acute respiratory syndrome virus
LVVSKAPLKYLYLLYRARYLLYCVSGNSVSLRNFRYISLLSKKVHKAASSKVLNVTPLNMTLFLR

SEQ ID NO: 1846 - protein, 15 aa, Human severe acute respiratory syndrome virus
LLKNQWQCFREIQNT

SEQ ID NO: 1847 - protein, 16 aa, Human severe acute respiratory syndrome virus
IAVIQKGTIGENMANH

SEQ ID NO: 1848 - protein, 9 aa, Human severe acute respiratory syndrome virus
AKNETSLVK

SEQ ID NO: 1849 - protein, 5 aa, Human severe acute respiratory syndrome virus
NVKYK

SEQ ID NO: 1850 - protein, 6 aa, Human severe acute respiratory syndrome virus
TPGRKL

SEQ ID NO: 1851 - protein, 34 aa, Human severe acute respiratory syndrome virus
AGARQSIVKDIKNKSALAATTWLYSPKARLNFIK

SEQ ID NO: 1852 - protein, 50 aa, Human severe acute respiratory syndrome virus
AAQVTNMAIIPPATTEADTSKAPTGCTRGVKMLAMRFIASTPQKTPDRAL

SEQ ID NO: 1853 - protein, 42 aa, Human severe acute respiratory syndrome virus
CSLLRTHLPLVDRQIPTSDLSHVPCLQYSASKVVTTLTEPSR

SEQ ID NO: 1854 - protein, 13 aa, Human severe acute respiratory syndrome virus
VLGNCMMEPSIST

SEQ ID NO: 1855 - protein, 8 aa, Human severe acute respiratory syndrome virus
RVSGRSSL

SEQ ID NO: 1856 - protein, 10 aa, Human severe acute respiratory syndrome virus
EIEPSSKLVS

SEQ ID NO: 1857 - protein, 36 aa, Human severe acute respiratory syndrome virus
QYGTGLPIASLKIVHSAARTQAEVAKSLYSMSLEGV

SEQ ID NO: 1858 - protein, 83 aa, Human severe acute respiratory syndrome virus
QMLPTALKTRGRKCKKSPLIALSTVPGKPGTMKPISLVMIAATTGQLLSFLYEPPRWLNHASKPACLFAKQSSVEMMSRVTPS

SEQ ID NO: 1859 - protein, 6 aa, Human severe acute respiratory syndrome virus
PMISFV

SEQ ID NO: 1860 - protein, 13 aa, Human severe acute respiratory syndrome virus
PSWIDNVCTGITI

SEQ ID NO: 1861 - protein, 69 aa, Human severe acute respiratory syndrome virus
QTNAARTHNNVALSISLKQVLTILPPLSEILVVMTLTTCLVVAQVSLKGMLFFLAALRICLRSCSDKDM

SEQ ID NO: 1862 - protein, 10 aa, Human severe acute respiratory syndrome virus
SFTFQMSETL

SEQ ID NO: 1863 - protein, 29 aa, Human severe acute respiratory syndrome virus
LFATWALICLALQSIHAPRSLGVMFSTLL

SEQ ID NO: 1864 - protein, 16 aa, Human severe acute respiratory syndrome virus
VSMKLLQLSPVTSKSE

SEQ ID NO: 1865 - protein, 42 aa, Human severe acute respiratory syndrome virus
CESLRHSITSFVSTSVSTTPCRAADTNVERTPSKATPFANSL

SEQ ID NO: 1866 - protein, 22 aa, Human severe acute respiratory syndrome virus
AVATSALSFSIGTLKVAEKVST

SEQ ID NO: 1867 - protein, 30 aa, Human severe acute respiratory syndrome virus
ASNILTETSVLSPTSDTRAWSSNRIGWHIS

SEQ ID NO: 1868 - protein, 47 aa, Human severe acute respiratory syndrome virus
YTEADLEADSSHLDLPSKTMTLIGSEPLVLLALKLSKLTKWERGCLS

SEQ ID NO: 1869 - protein, 5 aa, Human severe acute respiratory syndrome virus
PALSK

SEQ ID NO: 1870 - protein, 53 aa, Human severe acute respiratory syndrome virus
SAPFFTATLSTIYDDWSVGLIGLLNWSDKSRATSSLMNVLPVQNVSQLRQFQL

SEQ ID NO: 1871 - protein, 10 aa, Human severe acute respiratory syndrome virus
VLQKPRPPFA

SEQ ID NO: 1872 - protein, 21 aa, Human severe acute respiratory syndrome virus
KDLFMPLTIVVHSTRVARLRL

SEQ ID NO: 1873 - protein, 13 aa, Human severe acute respiratory syndrome virus
HIMQVEEVQPSMI

SEQ ID NO: 1874 - protein, 4 aa, Human severe acute respiratory syndrome virus
LFHM

SEQ ID NO: 1875 - protein, 33 aa, Human severe acute respiratory syndrome virus
KEAKKMYILTIAETGAICTILMINHMSQELLMK

SEQ ID NO: 1876 - protein, 13 aa, Human severe acute respiratory syndrome virus
PKNTCIIAERPNK

SEQ ID NO: 1877 - protein, 30 aa, Human severe acute respiratory syndrome virus
KNFVNNIYAKTHSAARPKIVKSSLYDEIVT

SEQ ID NO: 1878 - protein, 6 aa, Human severe acute respiratory syndrome virus
MVSRAG

SEQ ID NO: 1879 - protein, 38 aa, Human severe acute respiratory syndrome virus
ESRESNPLKQMLQGKEPSQKSIVVTLDELRYNSLTPLQ

SEQ ID NO: 1880 - protein, 44 aa, Human severe acute respiratory syndrome virus
EGAPKLDKSTPKAAVTQIREPKQILNNNSHIAIVNNLENLGDFT

SEQ ID NO: 1881 - protein, 45 aa, Human severe acute respiratory syndrome virus
LMPASKHNLATLLTLFLAIVVGSEALILELVLLVKVHNWNNNVNT

SEQ ID NO: 1882 - protein, 26 aa, Human severe acute respiratory syndrome virus
LLNTRCANLLAQFDVVIAACPKNGLT

SEQ ID NO: 1883 - protein, 15 aa, Human severe acute respiratory syndrome virus
AKILLQGTLLIAAIP

SEQ ID NO: 1884 - protein, 25 aa, Human severe acute respiratory syndrome virus
VAIVFKPKASESSLGFLMVMLVFST

SEQ ID NO: 1885 - protein, 6 aa, Human severe acute respiratory syndrome virus
AAIRSS

SEQ ID NO: 1886 - protein, 47 aa, Human severe acute respiratory syndrome virus
PNSCVTLTPSSDGLSMTLPTTSVVFTSHSMTSFCMVGFSTTSSEVGC

SEQ ID NO: 1887 - protein, 68 aa, Human severe acute respiratory syndrome virus
LSQARLSIPCVSSTARTSNEFEVSTGFVLQRQRKHQVFGLNVVLVVAWLMCQTIGLCSNLAPFLKLAE

SEQ ID NO: 1888 - protein, 28 aa, Human severe acute respiratory syndrome virus
SIATTSPFKSGKNVTDSSREAGFVKPVI

SEQ ID NO: 1889 - protein, 24 aa, Human severe acute respiratory syndrome virus
FKSSANFVLEHVSLKLSKLAFGNG

SEQ ID NO: 1890 - protein, 10 aa, Human severe acute respiratory syndrome virus
VGTRSIGCSV

SEQ ID NO: 1891 - protein, 5 aa, Human severe acute respiratory syndrome virus
ALSFL

SEQ ID NO: 1892 - protein, 10 aa, Human severe acute respiratory syndrome virus
YPSNFGSISV

SEQ ID NO: 1893 - protein, 15 aa, Human severe acute respiratory syndrome virus
VTPSSLYDTGLMVVV

SEQ ID NO: 1894 - protein, 4 aa, Human severe acute respiratory syndrome virus
DVSL

SEQ ID NO: 1895 - protein, 15 aa, Human severe acute respiratory syndrome virus
KTSVTGPLYSDIFVR

SEQ ID NO: 1896 - protein, 5 aa, Human severe acute respiratory syndrome virus
APSIR

SEQ ID NO: 1897 - protein, 7 aa, Human severe acute respiratory syndrome virus
RVSLAVI

SEQ ID NO: 1898 - protein, 54 aa, Human severe acute respiratory syndrome virus
LPVYSFAHKNVPCCNLYSAGGADIITKEDSCCTRYCVASRPHTHGMETPVLRLS

SEQ ID NO: 1899 - protein, 18 aa, Human severe acute respiratory syndrome virus
DRVPIYITASTPVKVVVF

SEQ ID NO: 1900 - protein, 39 aa, Human severe acute respiratory syndrome virus
PQCLHTTLRTRFADSKLACCRRWVIVSLTSPSSPTVLLL

SEQ ID NO: 1901 - protein, 16 aa, Human severe acute respiratory syndrome virus
ASMSAQKLAASPARAL

SEQ ID NO: 1902 - protein, 11 aa, Human severe acute respiratory syndrome virus
SAGALNLTSSC

SEQ ID NO: 1903 - protein, 8 aa, Human severe acute respiratory syndrome virus
SANKTLDK

SEQ ID NO: 1904 - protein, 14 aa, Human severe acute respiratory syndrome virus
QLLSAHLIEVKPPT

SEQ ID NO: 1905 - protein, 24 aa, Human severe acute respiratory syndrome virus
GNFHFFVWFKADMYLPRKLSSRVW

SEQ ID NO: 1906 - protein, 21 aa, Human severe acute respiratory syndrome virus
YSKASLRSVSSLGSTKKVLPS

SEQ ID NO: 1907 - protein, 64 aa, Human severe acute respiratory syndrome virus
GLIFVTSAPSKYVGPNCCPYVIDISTSCVWRLVLSTVVNTFIVLTSRRDKRLFSLSSERTSPSR

SEQ ID NO: 1908 - protein, 29 aa, Human severe acute respiratory syndrome virus
NSTGLSRVWYTILSPRLRNSTPNSVRCPE

SEQ ID NO: 1909 - protein, 4 aa, Human severe acute respiratory syndrome virus
DQSL

SEQ ID NO: 1910 - protein, 58 aa, Human severe acute respiratory syndrome virus
EPAKETVSTKCSSDVFDDEVRYPLYVVTASGDDTDTTAGALRERIQRAASSRLKPCVT

SEQ ID NO: 1911 - protein, 26 aa, Human severe acute respiratory syndrome virus
PIGIVTSGSFREFSFVIIEATGSLLV

SEQ ID NO: 1912 - protein, 6 aa, Human severe acute respiratory syndrome virus
KKNRTP

SEQ ID NO: 1913 - protein, 5 aa, Human severe acute respiratory syndrome virus
STMPS

SEQ ID NO: 1914 - protein, 30 aa, Human severe acute respiratory syndrome virus
ILIPLYLRWMVAIMALTSMHIGINFLVSSA

SEQ ID NO: 1915 - protein, 26 aa, Human severe acute respiratory syndrome virus
ASISLKFQDTVPRISSLALGASEGST

SEQ ID NO: 1916 - protein, 16 aa, Human severe acute respiratory syndrome virus
NADLHFLRAVLASSSV

SEQ ID NO: 1917 - protein, 51 aa, Human severe acute respiratory syndrome virus
PAHPCPGYVVIYSSTGTFFKALESISVVPPAFLEGITTQVISPLVITSPTM

SEQ ID NO: 1918 - protein, 16 aa, Human severe acute respiratory syndrome virus
GASFSRKDISSPLSMF

SEQ ID NO: 1919 - protein, 71 aa, Human severe acute respiratory syndrome virus
SLPLISANKSNLLVRNLVSSSVVVTSSMQALIFGFTSTGFCTTDFSSVLESSVFGGSSCLGASTLGFRLSR

SEQ ID NO: 1920 - protein, 6 aa, Human severe acute respiratory syndrome virus
SMTTCS

SEQ ID NO: 1921 - protein, 8 aa, Human severe acute respiratory syndrome virus
RALSLTAI

SEQ ID NO: 1922 - protein, 13 aa, Human severe acute respiratory syndrome virus
TCVRTVCTHTCKD

SEQ ID NO: 1923 - protein, 69 aa, Human severe acute respiratory syndrome virus
SGLAPNMPADNNGASKMSCELKFSYAALRSWMSSPAFRLGPTTCRHFLARLCPESKQDPPTVRGPFSLM

SEQ ID NO: 1924 - protein, 58 aa, Human severe acute respiratory syndrome virus
SSLSFCMAPLVALLSAPATPPPCFRCMLAAFTITIGLALCASLTMSTHLMATLSVSFK

SEQ ID NO: 1925 - protein, 46 aa, Human severe acute respiratory syndrome virus
LTGSSGVGSGSGSISDCSVVSSSQSSSSSSSTRTVSAEAPNSRGRP

SEQ ID NO: 1926 - protein, 30 aa, Human severe acute respiratory syndrome virus
SSSVPYSCSQVSSISSSSHSASSSSSSSGG

SEQ ID NO: 1927 - protein, 18 aa, Human severe acute respiratory syndrome virus
KEQYIRDEKFSSPASSNK

SEQ ID NO: 1928 - protein, 45 aa, Human severe acute respiratory syndrome virus
NVATLHSSRSIPMLVRRSETGCKVFTTASATTHANSVTSVPDSTV

SEQ ID NO: 1929 - protein, 23 aa, Human severe acute respiratory syndrome virus
TEHFSLSTLSTRSSSSNVILTFL

SEQ ID NO: 1930 - protein, 115 aa, Human severe acute respiratory syndrome virus
TSQTVSSPKVTPLIGAPPFKRKTLFVASKPGDNAQYCSLSLISKSMRPFTQTGVPTIAPFVKLSTGVSSASSSPFLRTTSSEVSTVSCESPSRKVTSFGALRGMSSCSCSLPRIH

SEQ ID NO: 1931 - protein, 4 aa, Human severe acute respiratory syndrome virus
SPLL

SEQ ID NO: 1932 - protein, 19 aa, Human severe acute respiratory syndrome virus
AMKTSPKLSDRNFAPAIVT

SEQ ID NO: 1933 - protein, 28 aa, Human severe acute respiratory syndrome virus
SMHISSALLTTSMKHFTQSLMLSEATCI

SEQ ID NO: 1934 - protein, 51 aa, Human severe acute respiratory syndrome virus
PLTMSKTPVMRNLRISQASLRNSTPALSFASIHSKIGLSFSTVVPKRLDNH

SEQ ID NO: 1935 - protein, 24 aa, Human severe acute respiratory syndrome virus
EVCCTRPPVTYAIIMTLLVSRSEV

SEQ ID NO: 1936 - protein, 76 aa, Human severe acute respiratory syndrome virus
TMASTRRNDCSEIPSSMVTAALCKSGIEWFAASSVRAKIDLITPAACEGKPHSGVKTDLCCPMFQAPFTGFPLVTL

SEQ ID NO: 1937 - protein, 12 aa, Human severe acute respiratory syndrome virus
LPQDSTMVLKDL

SEQ ID NO: 1938 - protein, 27 aa, Human severe acute respiratory syndrome virus
SRLFIVSIKALVEAEKDAKMMATSSFK

SEQ ID NO: 1939 - protein, 45 aa, Human severe acute respiratory syndrome virus
KSPTMLMLTRSRLSISRRSSFKVSTLSPVMPVWPEPISALARGTQ

SEQ ID NO: 1940 - protein, 4 aa, Human severe acute respiratory syndrome virus
ARLL

SEQ ID NO: 1941 - protein, 24 aa, Human severe acute respiratory syndrome virus
ANTQPPKHLVLPPLRSRVSMFEWL

SEQ ID NO: 1942 - protein, 12 aa, Human severe acute respiratory syndrome virus
SATLCSGPISGS

SEQ ID NO: 1943 - protein, 48 aa, Human severe acute respiratory syndrome virus
QAGHGIFTTALVGRYPHVVGPSITKFSVPQCSQVAFRKSHVCHETSSQ

SEQ ID NO: 1944 - protein, 39 aa, Human severe acute respiratory syndrome virus
LHFIKVDKCILLHSCGDATGYTERIRPMKPSVFFFSTRG

SEQ ID NO: 1945 - protein, 35 aa, Human severe acute respiratory syndrome virus
MTLTFELRGNTNFGHSPLKVSNFLALLISKGVWCS

SEQ ID NO: 1946 - protein, 19 aa, Human severe acute respiratory syndrome virus
LLSERSVNQAISCSWSRQQ

SEQ ID NO: 1947 - protein, 7 aa, Human severe acute respiratory syndrome virus
TPLFDSM

SEQ ID NO: 1948 - protein, 35 aa, Human severe acute respiratory syndrome virus
SSCSERVHIDLPARARKSLMQSRGYPSGPQKLLST

SEQ ID NO: 1949 - protein, 27 aa, Human severe acute respiratory syndrome virus
RVTAPPLSSRVSSRSAPLPCLVFQFCS

SEQ ID NO: 1950 - protein, 13 aa, Human severe acute respiratory syndrome virus
SSMGSVPSSSPKS

SEQ ID NO: 1951 - protein, 6 aa, Human severe acute respiratory syndrome virus
DFRSMP

SEQ ID NO: 1952 - protein, 37 aa, Human severe acute respiratory syndrome virus
PPAPLLPFLRRRTLRYAIGVSPTCGTSTPSVIPLRPY

SEQ ID NO: 1953 - protein, 14 aa, Human severe acute respiratory syndrome virus
MPSISATSSTTLWP

SEQ ID NO: 1954 - protein, 12 aa, Human severe acute respiratory syndrome virus
LVLKASERLMNT

SEQ ID NO: 1955 - protein, 45 aa, Human severe acute respiratory syndrome virus
GCSSWGSTPFSSSTRPQVPFLRCSRASDRASSTESPKPRTSTSLT

SEQ ID NO: 1956 - protein, 69 aa, Human severe acute respiratory syndrome virus
RTGKLSWTCVFSLTPRTRLSILPFGHTRTKPRYADDRLQHGRNRKQSAEEGRVTRFLSTTVKFIIVYTA

SEQ ID NO: 1957 - protein, 14 aa, Human severe acute respiratory syndrome virus
ACSRATATQILKFV

SEQ ID NO: 1958 - protein, 15 aa, Human severe acute respiratory syndrome virus
RTDLQEIEVGWLFLG

SEQ ID NO: 1959 - DNA, 29736 bp, Human severe acute respiratory syndrome virus; identical to SEQ ID NO: 1102
  CDS (3)..(29735)

SEQ ID NO: 1960 - protein, 29 aa, Human severe acute respiratory syndrome virus
FFFFFFFCHSPKKLLKSHGDSTTKINFTH

SEQ ID NO: 1961 - protein, 4 aa, Human severe acute respiratory syndrome virus
GSSI

SEQ ID NO: 1962 - protein, 29 aa, Human severe acute respiratory syndrome virus
AALPSIIHCTLDRTPRGLDENVVALSSPP

SEQ ID NO: 1963 - protein, 21 aa, Human severe acute respiratory syndrome virus
CYTLIKDCYVRLKLTKPTCAV

SEQ ID NO: 1964 - protein, 22 aa, Human severe acute respiratory syndrome virus
LREFILHKSRLCIVNGIAKTFT

SEQ ID NO: 1965 - protein, 8 aa, Human severe acute respiratory syndrome virus
PICLVWSS

SEQ ID NO: 1966 - protein, 55 aa, Human severe acute respiratory syndrome virus
VFMPELNQQKLHSWNFEVVWRNHPCQPQEEESQWAASFVSAAKAELHQSFSFCPF

SEQ ID NO: 1967 - protein, 17 aa, Human severe acute respiratory syndrome virus
ALLVGMFCMRQCACSAV

SEQ ID NO: 1968 - protein, 8 aa, Human severe acute respiratory syndrome virus
IVDLCHPI

SEQ ID NO: 1969 - protein, 12 aa, Human severe acute respiratory syndrome virus
WLHDKSAMFPKV

SEQ ID NO: 1970 - protein, 31 aa, Human severe acute respiratory syndrome virus
LPCQCVTFQRMQRHLEQIVQFAANVCNQFLV

SEQ ID NO: 1971 - protein, 21 aa, Human severe acute respiratory syndrome virus
LGLGPRNFLGFVLDHVSQMLE

SEQ ID NO: 1972 - protein, 14 aa, Human severe acute respiratory syndrome virus
RCTVLWQYVFGEAF

SEQ ID NO: 1973 - protein, 7 aa, Human severe acute respiratory syndrome virus
MPQQQIS

SEQ ID NO: 1974 - protein, 34 aa, Human severe acute respiratory syndrome virus
QFGLVVVGLYQKLCSQAGSICLAAIARGQFHHLR

SEQ ID NO: 1975 - protein, 59 aa, Human severe acute respiratory syndrome virus
PFEQENFPYCCQELNFLNYRDYVMRSEKRLDCRLCFPLRRSLLAMLFLEEVVARWQHCY

SEQ ID NO: 1976 - protein, 25 aa, Human severe acute respiratory syndrome virus
DCGCQCGLWVYSRLPQLQPIRCLLC

SEQ ID NO: 1977 - protein, 20 aa, Human severe acute respiratory syndrome virus
RRREVKLLGQFLGNRSTIWG

SEQ ID NO: 1978 - protein, 13 aa, Human severe acute respiratory syndrome virus
ALSFCRHHHELVG

SEQ ID NO: 1979 - protein, 15 aa, Human severe acute respiratory syndrome virus
LFGSSQFGHLDHYWC

SEQ ID NO: 1980 - protein, 9 aa, Human severe acute respiratory syndrome virus
LERPGLEGI

SEQ ID NO: 1981 - protein, 7 aa, Human severe acute respiratory syndrome virus
VPPCHAE

SEQ ID NO: 1982 - protein, 37 aa, Human severe acute respiratory syndrome virus
TKTQYYWVNLGVGAVLALPHCVLHSGYCQLNLWVHQM

SEQ ID NO: 1983 - protein, 16 aa, Human severe acute respiratory syndrome virus
CGGHYVGLIGVHYQTF

SEQ ID NO: 1984 - protein, 17 aa, Human severe acute respiratory syndrome virus
FVRLFKTTSTSLNAAVW

SEQ ID NO: 1985 - protein, 14 aa, Human severe acute respiratory syndrome virus
RYQHLAISAPPAGS

SEQ ID NO: 1986 - protein, 10 aa, Human severe acute respiratory syndrome virus
QLIVTLGVHV

SEQ ID NO: 1987 - protein, 6 aa, Human severe acute respiratory syndrome virus
TIVCHL

SEQ ID NO: 1988 - protein, 14 aa, Human severe acute respiratory syndrome virus
KGKTFPRAQSQAVL

SEQ ID NO: 1989 - protein, 31 aa, Human severe acute respiratory syndrome virus
VLPLVLYLTRIFKHMRFIRCTALYYSAYATA

SEQ ID NO: 1990 - protein, 21 aa, Human severe acute respiratory syndrome virus
RNTSQNNEKFHVRLDFGTRFF

SEQ ID NO: 1991 - protein, 5 aa, Human severe acute respiratory syndrome virus
ILDFE

SEQ ID NO: 1992 - protein, 8 aa, Human severe acute respiratory syndrome virus
KPKYNKHY

SEQ ID NO: 1993 - protein, 7 aa, Human severe acute respiratory syndrome virus
KAQIEVN

SEQ ID NO: 1994 - protein, 29 aa, Human severe acute respiratory syndrome virus
SELIHSVFLLMVKQSIKNTRAATMRKSGE

SEQ ID NO: 1995 - protein, 17 aa, Human severe acute respiratory syndrome virus
TSSCLMKSFGETDLARS

SEQ ID NO: 1996 - protein, 27 aa, Human severe acute respiratory syndrome virus
VCRVPSAQAKAKCVLVQVSANLLSARG

SEQ ID NO: 1997 - protein, 25 aa, Human severe acute respiratory syndrome virus
NGELPSYVPDGQGSFSSTVVPLTHS

SEQ ID NO: 1998 - protein, 24 aa, Human severe acute respiratory syndrome virus
YSSQDVNTINVRKRIIFMFVLWII

SEQ ID NO: 1999 - protein, 7 aa, Human severe acute respiratory syndrome virus
LHRFFII

SEQ ID NO: 2000 - protein, 7 aa, Human severe acute respiratory syndrome virus
LRIILLS

SEQ ID NO: 2001 - protein, 4 aa, Human severe acute respiratory syndrome virus
LSHY

SEQ ID NO: 2002 - protein, 89 aa, Human severe acute respiratory syndrome virus
TYYNVKIPNSNPESPHNDNQYLCYCNLEVNKMKHLLSLTVLAKQYCRCYRRGLYLIYSFQYGSGCMQQNLNQCLHAATLLICNKKAFVM

SEQ ID NO: 2003 - protein, 6 aa, Human severe acute respiratory syndrome virus
SLLAGP

SEQ ID NO: 2004 - protein, 16 aa, Human severe acute respiratory syndrome virus
CHSALGSVRPFASDHE

SEQ ID NO: 2005 - protein, 4 aa, Human severe acute respiratory syndrome virus
SQHQ

SEQ ID NO: 2006 - protein, 5 aa, Human severe acute respiratory syndrome virus
QVHFP

SEQ ID NO: 2007 - protein, 12 aa, Human severe acute respiratory syndrome virus
AVWSQLSPGEAH

SEQ ID NO: 2008 - protein, 7 aa, Human severe acute respiratory syndrome virus
EECLFLG

SEQ ID NO: 2009 - protein, 11 aa, Human severe acute respiratory syndrome virus
MTTLSGYEQTA

SEQ ID NO: 2010 - protein, 6 aa, Human severe acute respiratory syndrome virus
RKQRSS

SEQ ID NO: 2011 - protein, 19 aa, Human severe acute respiratory syndrome virus
ATSSLQYKPLQSQSRQSPN

SEQ ID NO: 2012 - protein, 32 aa, Human severe acute respiratory syndrome virus
FCRQQQAQNKQVLLATRARGKQALLCTKTCSD

SEQ ID NO: 2013 - protein, 7 aa, Human severe acute respiratory syndrome virus
NRQIVVT

SEQ ID NO: 2014 - protein, 18 aa, Human severe acute respiratory syndrome virus
SRLGIGNLLLGSIVPGVV

SEQ ID NO: 2015 - protein, 4 aa, Human severe acute respiratory syndrome virus
APQR

SEQ ID NO: 2016 - protein, 5 aa, Human severe acute respiratory syndrome virus
YRCLP

SEQ ID NO: 2017 - protein, 8 aa, Human severe acute respiratory syndrome virus
AMLKFQTE

SEQ ID NO: 2018 - protein, 29 aa, Human severe acute respiratory syndrome virus
LVRLDQKIRNSFRRVQIFNTRVDVNRWFY

SEQ ID NO: 2019 - protein, 19 aa, Human severe acute respiratory syndrome virus
THVNNIAAVRTQSKRSKDG

SEQ ID NO: 2020 - protein, 15 aa, Human severe acute respiratory syndrome virus
QEYHESKKKKYAINY

SEQ ID NO: 2021 - protein, 8 aa, Human severe acute respiratory syndrome virus
RTCFFRNE

SEQ ID NO: 2022 - protein, 33 aa, Human severe acute respiratory syndrome virus
VHKFVLTFLCLQRHASSRRRLIINWIHCWISNS

SEQ ID NO: 2023 - protein, 56 aa, Human severe acute respiratory syndrome virus
RAVDCVYLHIRWVFNKLVKDEECSIFNTSVCSNLCRLKLVVNFGEIAMYNDIVFNT

SEQ ID NO: 2024 - protein, 18 aa, Human severe acute respiratory syndrome virus
VPILRITTNLVVFFEFWC

SEQ ID NO: 2025 - protein, 36 aa, Human severe acute respiratory syndrome virus
NAVTFSNDNCICDTVIWYTVVIVMCVPANKVVGIIK

SEQ ID NO: 2026 - protein, 23 aa, Human severe acute respiratory syndrome virus
WVLGFALPTKPTSHNNSTCVDAL

SEQ ID NO: 2027 - protein, 22 aa, Human severe acute respiratory syndrome virus
KIYQGIEVQKLRLHTCSDKQKM

SEQ ID NO: 2028 - protein, 5 aa, Human severe acute respiratory syndrome virus
IDGNK

SEQ ID NO: 2029 - protein, 11 aa, Human severe acute respiratory syndrome virus
IANELEALIKG

SEQ ID NO: 2030 - protein, 30 aa, Human severe acute respiratory syndrome virus
LPSFIERNYFGSALKNSKKCNANNKPSERE

SEQ ID NO: 2031 - protein, 24 aa, Human severe acute respiratory syndrome virus
RYRCCSMNSTCRRSIVNFYWLCSN

SEQ ID NO: 2032 - protein, 16 aa, Human severe acute respiratory syndrome virus
SKSKKSHKQIHKFVYV

SEQ ID NO: 2033 - protein, 70 aa, Human severe acute respiratory syndrome virus
CNLTPLRTGSESSSSNLQQEPQEHAPLRQLQQLVMQQSKIVTMTMAISPAMKPSQTYQGHLIYCSYFPNS

SEQ ID NO: 2034 - protein, 20 aa, Human severe acute respiratory syndrome virus
RSMSDSFKFLATSLRRSISF

SEQ ID NO: 2035 - protein, 20 aa, Human severe acute respiratory syndrome virus
MLTTEALMPEMSPRSTSGDV

SEQ ID NO: 2036 - protein, 20 aa, Human severe acute respiratory syndrome virus
FLKYLSSSSLNESSSGCRGS

SEQ ID NO: 2037 - protein, 54 aa, Human severe acute respiratory syndrome virus
TVLLMMPITTSQFPETNVLSVVIICGEKKFLCVINQEVPLNTKTPSRGKYALPS

SEQ ID NO: 2038 - protein, 35 aa, Human severe acute respiratory syndrome virus
QIAGAVVKFLSWDGTYVTCRKTTPCGAACGKDIRW

SEQ ID NO: 2039 - protein, 39 aa, Human severe acute respiratory syndrome virus
PFPQKSTLFDCPRTHSDILVAARLAEALISAALISCCVT

SEQ ID NO: 2040 - protein, 44 aa, Human severe acute respiratory syndrome virus
SLPVINLSICTSASTLSSRERISFSTLEIAPKLELSCLTSVFNA

SEQ ID NO: 2041 - protein, 21 aa, Human severe acute respiratory syndrome virus
AFWLTTSCSLPNAVDVVVSDS

SEQ ID NO: 2042 - protein, 15 aa, Human severe acute respiratory syndrome virus
LIALLNWLAICFWFS

SEQ ID NO: 2043 - protein, 21 aa, Human severe acute respiratory syndrome virus
RTFWVTPMPLNLYAICIAKGI

SEQ ID NO: 2044 - protein, 21 aa, Human severe acute respiratory syndrome virus
RAAPAPNVHPAVAVPLTRAAV

SEQ ID NO: 2045 - protein, 88 aa, Human severe acute respiratory syndrome virus
AAIISSVSRGGNTVSPLNFCAQMRSLALISPRHSPYCFMKPASASVTLLKSKSSIKDLLVGFRGSGNICEKLKPPKYFKVGVLYICLT

SEQ ID NO: 2046 - protein, 76 aa, Human severe acute respiratory syndrome virus
ANTSRVLRSCSAAIPESARFSCVQKLPYWRSKLAHSVESPQMYILQSTEVLAIETGITSVVMLIEKLVGIAMVLLE

SEQ ID NO: 2047 - protein, 11 aa, Human severe acute respiratory syndrome virus
AIELSAPKDIV

SEQ ID NO: 2048 - protein, 16 aa, Human severe acute respiratory syndrome virus
ATIDFWLVLRNKETVW

SEQ ID NO: 2049 - protein, 13 aa, Human severe acute respiratory syndrome virus
LAQMPAPIGMSHS

SEQ ID NO: 2050 - protein, 13 aa, Human severe acute respiratory syndrome virus
EVSTCSAPIRQPA

SEQ ID NO: 2051 - protein, 17 aa, Human severe acute respiratory syndrome virus
VWNTLFPVEYMRQAGVS

SEQ ID NO: 2052 - protein, 11 aa, Human severe acute respiratory syndrome virus
IAVETSVQLTS

SEQ ID NO: 2053 - protein, 49 aa, Human severe acute respiratory syndrome virus
YRTATSDEAFVPGVITLTPPKEQGEMSNISDVLGSRTESVKSETSRPNC

SEQ ID NO: 2054 - protein, 51 aa, Human severe acute respiratory syndrome virus
NLFEEGVNTPVPVSPLKLKLTHWFLIRSVDNFGPQTVAGAFKSSKESTTTL

SEQ ID NO: 2055 - protein, 6 aa, Human severe acute respiratory syndrome virus
PMPVVV

SEQ ID NO: 2056 - protein, 5 aa, Human severe acute respiratory syndrome virus
SFNGQ

SEQ ID NO: 2057 - protein, 36 aa, Human severe acute respiratory syndrome virus
QLRAGGVQGLPSGEKGTLDMSLSKGLSLPCLRYLYL

SEQ ID NO: 2058 - protein, 25 aa, Human severe acute respiratory syndrome virus
LPVEVASMFLVFQARTQPMKSSGNL

SEQ ID NO: 2059 - protein, 24 aa, Human severe acute respiratory syndrome virus
SAITPVCPGAICLTSSPLTTKESA

SEQ ID NO: 2060 - protein, 15 aa, Human severe acute respiratory syndrome virus
TLEKQRSFNLVAETP

SEQ ID NO: 2061 - protein, 10 aa, Human severe acute respiratory syndrome virus
HLKVEKNVEL

SEQ ID NO: 2062 - protein, 13 aa, Human severe acute respiratory syndrome virus
SATQLEIFFLSHA

SEQ ID NO: 2063 - protein, 37 aa, Human severe acute respiratory syndrome virus
TEGNLVALKTSPKGHKFVILGNLTTSPEGTTLKLEVW

SEQ ID NO: 2064 - protein, 19 aa, Human severe acute respiratory syndrome virus
IPLSISKLLTEHLSSASGF

SEQ ID NO: 2065 - protein, 23 aa, Human severe acute respiratory syndrome virus
EQSTASVIVPFSSYLSINVVGFK

SEQ ID NO: 2066 - protein, 9 aa, Human severe acute respiratory syndrome virus
AAADVPQVS

SEQ ID NO: 2067 - protein, 40 aa, Human severe acute respiratory syndrome virus
AGEKAVRMALKFVMLIPRGNLKIGFKVLKPEGRSRTTSIG

SEQ ID NO: 2068 - protein, 106 aa, Human severe acute respiratory syndrome virus
RNPSLFLNTNSRKCLKLPDFSETSSEKASDMYSKVQLNALSNIIVCVCVPMGLETAKKGLSHNSKLHARITTLVELLIIITDCDLLFMVEPKTQPRTTFDFSVAAK

SEQ ID NO: 2069 - protein, 13 aa, Human severe acute respiratory syndrome virus
IPSLKGMTGLSNV

SEQ ID NO: 2070 - protein, 6 aa, Human severe acute respiratory syndrome virus
NPVTLE

SEQ ID NO: 2071 - protein, 6 aa, Human severe acute respiratory syndrome virus
NGRNKS

SEQ ID NO: 2072 - protein, 10 aa, Human severe acute respiratory syndrome virus
RVSDLKISSG

SEQ ID NO: 2073 - protein, 8 aa, Human severe acute respiratory syndrome virus
TPLIDEVC

SEQ ID NO: 2074 - protein, 27 aa, Human severe acute respiratory syndrome virus
TSSKVVHRSRSLPLVRVRNNKKINMFV

SEQ ID NO: 2075 - protein, 26 aa, Human severe acute respiratory syndrome virus
LLTRISLETTTLLFSLMISLPFSRRE

SEQ ID NO: 2076 - protein, 5 aa, Human severe acute respiratory syndrome virus
IISLI

SEQ ID NO: 2077 - protein, 23 aa, Human severe acute respiratory syndrome virus
FSLRDITAVPLNLRGNLLMSKSE

SEQ ID NO: 2078 - protein, 13 aa, Human severe acute respiratory syndrome virus
EDNWIGFVFLQKM

SEQ ID NO: 2079 - protein, 5 aa, Human severe acute respiratory syndrome virus
LACMV

SEQ ID NO: 2080 - protein, 10 aa, Human severe acute respiratory syndrome virus
PSICSFGLPR

SEQ ID NO: 2081 - protein, 29 aa, Human severe acute respiratory syndrome virus
LAPIKNASDDDAFTFVTKAVHHEKWPISL

SEQ ID NO: 2082 - protein, 28 aa, Human severe acute respiratory syndrome virus
RSAFQECSVIFTAIEPPRASFCFINPHR

SEQ ID NO: 2083 - protein, 82 aa, Human severe acute respiratory syndrome virus
VKNPSLESFSFVTCLVLGSYISLIIRSHLLAVCTVAQSPIKVESASETKSLRSESTSSVPVGNHCLSTAVPGATPLSEPAPK

SEQ ID NO: 2084 - protein, 5 aa, Human severe acute respiratory syndrome virus
ITLML

SEQ ID NO: 2085 - protein, 10 aa, Human severe acute respiratory syndrome virus
GTAKVSVFKY

SEQ ID NO: 2086 - protein, 18 aa, Human severe acute respiratory syndrome virus
VYFATFIIIPFGITAFSP

SEQ ID NO: 2087 - protein, 24 aa, Human severe acute respiratory syndrome virus
RSHFSRSILCILYKLGIATPGCHA

SEQ ID NO: 2088 - protein, 6 aa, Human severe acute respiratory syndrome virus
LACSFG

SEQ ID NO: 2089 - protein, 17 aa, Human severe acute respiratory syndrome virus
KVSTCPSLHQSMNEISA

SEQ ID NO: 2090 - protein, 45 aa, Human severe acute respiratory syndrome virus
SIVTLTTFEITDKSCDFIISTKSSSKRSITEHTHFDEPVCASVMK

SEQ ID NO: 2091 - protein, 28 aa, Human severe acute respiratory syndrome virus
FFTVLSIGIKSSNLSGESCERLAKPIIK

SEQ ID NO: 2092 - protein, 6 aa, Human severe acute respiratory syndrome virus
RPPSCP

SEQ ID NO: 2093 - protein, 4 aa, Human severe acute respiratory syndrome virus
LKSP

SEQ ID NO: 2094 - protein, 6 aa, Human severe acute respiratory syndrome virus
TMCSKA

SEQ ID NO: 2095 - protein, 33 aa, Human severe acute respiratory syndrome virus
PSSLYRCMNSSIASSRKSVSICDLGLKSSKSLL

SEQ ID NO: 2096 - protein, 5 aa, Human severe acute respiratory syndrome virus
VSGNC

SEQ ID NO: 2097 - protein, 8 aa, Human severe acute respiratory syndrome virus
IMPSTFLK

SEQ ID NO: 2098 - protein, 89 aa, Human severe acute respiratory syndrome virus
LNCVFTDSPINVTPLTLACAGPFEGVRPLTEPSVIKTPLRAFLKRSTCPSTLPSNKTVSEEQALSVGFLAMSVIVQTPIVDTCAGASLL

SEQ ID NO: 2099 - protein, 55 aa, Human severe acute respiratory syndrome virus
SQITVLAAISTPKLLSILISGTGLMLRLAQSSNATLTGSVVLFSKISTSIPSTFV

SEQ ID NO: 2100 - protein, 24 aa, Human severe acute respiratory syndrome virus
TALLMMETGASPACPSKCPLLTTL

SEQ ID NO: 2101 - protein, 16 aa, Human severe acute respiratory syndrome virus
ATFSKLCNLVNVFHRL

SEQ ID NO: 2102 - protein, 5 aa, Human severe acute respiratory syndrome virus
VSNCL

SEQ ID NO: 2103 - protein, 45 aa, Human severe acute respiratory syndrome virus
IHRLNPAEIIILYASKYCRYSFAWCLQTAPPKLHRVIHVADLSGT

SEQ ID NO: 2104 - protein, 9 aa, Human severe acute respiratory syndrome virus
SISDTTCLP

SEQ ID NO: 2105 - protein, 7 aa, Human severe acute respiratory syndrome virus
DSQGLSE

SEQ ID NO: 2106 - protein, 53 aa, Human severe acute respiratory syndrome virus
KKGNCFKLVNALLSKAGVWNACLFTYKLPPSQPGKFKFDKTLVSNLHTIALAG

SEQ ID NO: 2107 - protein, 17 aa, Human severe acute respiratory syndrome virus
RSTLQFQNKQTPSVNLS

SEQ ID NO: 2108 - protein, 6 aa, Human severe acute respiratory syndrome virus
KSSSIL

SEQ ID NO: 2109 - protein, 6 aa, Human severe acute respiratory syndrome virus
ALSLHG

SEQ ID NO: 2110 - protein, 7 aa, Human severe acute respiratory syndrome virus
NFHSTSA

SEQ ID NO: 2111 - protein, 12 aa, Human severe acute respiratory syndrome virus
GTHLIAFGFPMS

SEQ ID NO: 2112 - protein, 75 aa, Human severe acute respiratory syndrome virus
RTGNLSASNADFTTMCCTFLQAELTLSSSPIIGYSTDQSTRLTKHSWTAKHLVMIASQLATCAFPCTWQCWSWLL

SEQ ID NO: 2113 - protein, 8 aa, Human severe acute respiratory syndrome virus
RLPVKPHC

SEQ ID NO: 2114 - protein, 7 aa, Human severe acute respiratory syndrome virus
TSIINGL

SEQ ID NO: 2115 - protein, 5 aa, Human severe acute respiratory syndrome virus
SKPTE

SEQ ID NO: 2116 - protein, 4 aa, Human severe acute respiratory syndrome virus
FQQA

SEQ ID NO: 2117 - protein, 99 aa, Human severe acute respiratory syndrome virus
VSDEVEKQVARLSHRQHVLSGPILTKYFIDVSSKPCAQRTNTTLSDNPFSVSLSICTILIRTTFQGKPLYMSGIRCLNWSPGGGFALTLVNSVLFSVST

SEQ ID NO: 2118 - protein, 28 aa, Human severe acute respiratory syndrome virus
PVGTATKLTPVENPSWRGRLVPTASLVA

SEQ ID NO: 2119 - protein, 12 aa, Human severe acute respiratory syndrome virus
QPSTSKPIHART

SEQ ID NO: 2120 - protein, 12 aa, Human severe acute respiratory syndrome virus
RIASSRVINILG

SEQ ID NO: 2121 - protein, 4 aa, Human severe acute respiratory syndrome virus
PLTW

SEQ ID NO: 2122 - protein, 12 aa, Human severe acute respiratory syndrome virus
FILKPIIEMSLR

SEQ ID NO: 2123 - protein, 31 aa, Human severe acute respiratory syndrome virus
VMSFGMPGMSTHNPSVLNFISTLRCVGACVG

SEQ ID NO: 2124 - protein, 37 aa, Human severe acute respiratory syndrome virus
RPVMILLQSLKSPVTFSACNVATLRRGISRLVNCSLS

SEQ ID NO: 2125 - protein, 38 aa, Human severe acute respiratory syndrome virus
RSLSDIMHKMPIFALVIATLKRLTLQECAVSVVCVNMT

SEQ ID NO: 2126 - protein, 27 aa, Human severe acute respiratory syndrome virus
SYSEPCDESTVCVGNPKIFEATAFCEL

SEQ ID NO: 2127 - protein, 22 aa, Human severe acute respiratory syndrome virus
GEIKTAFLQAGLRVRNSLTTPI

SEQ ID NO: 2128 - protein, 15 aa, Human severe acute respiratory syndrome virus
GLLIADETSCVITPL

SEQ ID NO: 2129 - protein, 5 aa, Human severe acute respiratory syndrome virus
NILKH

SEQ ID NO: 2130 - protein, 12 aa, Human severe acute respiratory syndrome virus
ADFSLCAFSLLS

SEQ ID NO: 2131 - protein, 52 aa, Human severe acute respiratory syndrome virus
TKALTVSTISAGQRRQVPRNMSGPIVFISLHTELKYSGSSVPLVSNVRGAGN

SEQ ID NO: 2132 - protein, 5 aa, Human severe acute respiratory syndrome virus
AGSPI

SEQ ID NO: 2133 - protein, 13 aa, Human severe acute respiratory syndrome virus
CFARSLALTTLKS

SEQ ID NO: 2134 - protein, 70 aa, Human severe acute respiratory syndrome virus
LVAIEISSKTTMSAVVSGNAFTVQKTYCSSVEFTLNLSKHSTRARAGMILLHLSMGKYFNAFSHRASTAA

SEQ ID NO: 2135 - protein, 11 aa, Human severe acute respiratory syndrome virus
EHAVYTMRADG

SEQ ID NO: 2136 - protein, 7 aa, Human severe acute respiratory syndrome virus
RASPMAK

SEQ ID NO: 2137 - protein, 19 aa, Human severe acute respiratory syndrome virus
LLPVPGGPWSVEYFCMPTF

SEQ ID NO: 2138 - protein, 22 aa, Human severe acute respiratory syndrome virus
FATLLENSSEMLSVGYKPVILT

SEQ ID NO: 2139 - protein, 15 aa, Human severe acute respiratory syndrome virus
CSCGTRVGALSGITV

SEQ ID NO: 2140 - protein, 5 aa, Human severe acute respiratory syndrome virus
DVNTK

SEQ ID NO: 2141 - protein, 18 aa, Human severe acute respiratory syndrome virus
SPTFNLYVVVPLYTTASP

SEQ ID NO: 2142 - protein, 19 aa, Human severe acute respiratory syndrome virus
SPFSKVYSPICTLLFLVTR

SEQ ID NO: 2143 - protein, 4 aa, Human severe acute respiratory syndrome virus
PVKT

SEQ ID NO: 2144 - protein, 59 aa, Human severe acute respiratory syndrome virus
FLFNGGLGFPTSHERCNSLSESTSRTVAIPYDSLNVSSVALSVSAAKSLSLSVQVLASM

SEQ ID NO: 2145 - protein, 31 aa, Human severe acute respiratory syndrome virus
SPALVQSHVAIALKSVTLSLPTHVFLYKPKT

SEQ ID NO: 2146 - protein, 16 aa, Human severe acute respiratory syndrome virus
PLAHNGKLMGGLCDLQ

SEQ ID NO: 2147 - protein, 21 aa, Human severe acute respiratory syndrome virus
LIPPRYSCVTSVTSQPGALQT

SEQ ID NO: 2148 - protein, 16 aa, Human severe acute respiratory syndrome virus
GLTDNTNLCDVEMTWS

SEQ ID NO: 2149 - protein, 41 aa, Human severe acute respiratory syndrome virus
QHLQHRNGLLIQAPQRSEVCELHNTQAPTACKTVCGVYIAS

SEQ ID NO: 2150 - protein, 38 aa, Human severe acute respiratory syndrome virus
NSGSQYREVLSLVSITEYMSNMWPVSSSCNFLMYCKYK

SEQ ID NO: 2151 - protein, 6 aa, Human severe acute respiratory syndrome virus
KTSAYS

SEQ ID NO: 2152 - protein, 7 aa, Human severe acute respiratory syndrome virus
LGCFVSG

SEQ ID NO: 2153 - protein, 35 aa, Human severe acute respiratory syndrome virus
ASIASDTNLSIISVPSVLTISSTKQPAPNILDGSG

SEQ ID NO: 2154 - protein, 4 aa, Human severe acute respiratory syndrome virus
GRYT

SEQ ID NO: 2155 - protein, 15 aa, Human severe acute respiratory syndrome virus
SSPCLTSIVCCEQNS

SEQ ID NO: 2156 - protein, 20 aa, Human severe acute respiratory syndrome virus
GPLVRSVSVQHFASDMNTLF

SEQ ID NO: 2157 - protein, 13 aa, Human severe acute respiratory syndrome virus
RTALKFLMLATKP

SEQ ID NO: 2158 - protein, 17 aa, Human severe acute respiratory syndrome virus
HTTASSERIIMEKCLRR

SEQ ID NO: 2159 - protein, 6 aa, Human severe acute respiratory syndrome virus
NSSTNS

SEQ ID NO: 2160 - protein, 6 aa, Human severe acute respiratory syndrome virus
STSLFL

SEQ ID NO: 2161 - protein, 29 aa, Human severe acute respiratory syndrome virus
SLCCRLRTYLSAILLPSVERSAFTLAVTA

SEQ ID NO: 2162 - protein, 8 aa, Human severe acute respiratory syndrome virus
QMLKTLLA

SEQ ID NO: 2163 - protein, 35 aa, Human severe acute respiratory syndrome virus
AVVASPDDVPPGLTYSEPPHMTISLNTCAHSLANL

SEQ ID NO: 2164 - protein, 33 aa, Human severe acute respiratory syndrome virus
KRCDKLQQVLCLRARTREAIILSMLGMALSHFG

SEQ ID NO: 2165 - protein, 12 aa, Human severe acute respiratory syndrome virus
SQPIRCGVSTSL

SEQ ID NO: 2166 - protein, 10 aa, Human severe acute respiratory syndrome virus
TVFNILCQPP

SEQ ID NO: 2167 - protein, 21 aa, Human severe acute respiratory syndrome virus
NLLVPITTVAPLVAAIDFNNF

SEQ ID NO: 2168 - protein, 30 aa, Human severe acute respiratory syndrome virus
NCLFVIVLQIETPATVRALFFALMAYLRFI

SEQ ID NO: 2169 - protein, 16 aa, Human severe acute respiratory syndrome virus
VIVGMTLRLVYAKSAS

SEQ ID NO: 2170 - protein, 4 aa, Human severe acute respiratory syndrome virus
LIES

SEQ ID NO: 2171 - protein, 31 aa, Human severe acute respiratory syndrome virus
SLALPHLLNGKPADLSRLLTITWLALIQPPS

SEQ ID NO: 2172 - protein, 24 aa, Human severe acute respiratory syndrome virus
QSKYLSTTSTTNRSCLISHIVGRL

SEQ ID NO: 2173 - protein, 8 aa, Human severe acute respiratory syndrome virus
SLIAALPS

SEQ ID NO: 2174 - protein, 23 aa, Human severe acute respiratory syndrome virus
AKKKCFSSTELPSLKKPLDTAKS

SEQ ID NO: 2175 - protein, 11 aa, Human severe acute respiratory syndrome virus
KSLLKLPGLTV

SEQ ID NO: 2176 - protein, 50 aa, Human severe acute respiratory syndrome virus
KATLFVSAATEKHVVRLSSNKLPEAACIAGSAAYTKSSLKLRRELCKFTS

SEQ ID NO: 2177 - protein, 47 aa, Human severe acute respiratory syndrome virus
LCTTPNSRKWYPVETTKGTPSTNIFLTSGPKLVGGNTVENNTLKFAQ

SEQ ID NO: 2178 - protein, 22 aa, Human severe acute respiratory syndrome virus
RIHLSSKQLIQLGWYVWSQYLK

SEQ ID NO: 2179 - protein, 47 aa, Human severe acute respiratory syndrome virus
RSKRQSLSSVKSYFSKSHLISGFARSASIWDSAANALVKVRMGISNE

SEQ ID NO: 2180 - protein, 27 aa, Human severe acute respiratory syndrome virus
YESTIGTPQPGATCTKSPKSYQFPLRS

SEQ ID NO: 2181 - protein, 53 aa, Human severe acute respiratory syndrome virus
LSNVSTPTMPASRIASQNCTVFNNDWRTRSPKLAYTRKMSGFSTKSYQSFLLK

SEQ ID NO: 2182 - protein, 22 aa, Human severe acute respiratory syndrome virus
SSSQQLYVTSISFNVSQLPSSK

SEQ ID NO: 2183 - protein, 11 aa, Human severe acute respiratory syndrome virus
TKSAIVYLVRR

SEQ ID NO: 2184 - protein, 29 aa, Human severe acute respiratory syndrome virus
RDICGTMSPSTLNLKKSWTATAGQSLTKL

SEQ ID NO: 2185 - protein, 6 aa, Human severe acute respiratory syndrome virus
IVSSCW

SEQ ID NO: 2186 - protein, 10 aa, Human severe acute respiratory syndrome virus
LDIVCLLTTK

SEQ ID NO: 2187 - protein, 30 aa, Human severe acute respiratory syndrome virus
ESNKLPSSSFSWKRQQLVFRNFAKPATFSL

SEQ ID NO: 2188 - protein, 5 aa, Human severe acute respiratory syndrome virus
ISKAL

SEQ ID NO: 2189 - protein, 57 aa, Human severe acute respiratory syndrome virus
TTSVLVPVPHGVRRAALTPQTRLKTLMHPQTASRVRGVGHNYSHNLSTFRRRYRLCF

SEQ ID NO: 2190 - protein, 5 aa, Human severe acute respiratory syndrome virus
NPLGH

SEQ ID NO: 2191 - protein, 13 aa, Human severe acute respiratory syndrome virus
VFGRTYLSSHRIL

SEQ ID NO: 2192 - protein, 24 aa, Human severe acute respiratory syndrome virus
DLDGQCGIYNTDNMKHHQRTLGPC

SEQ ID NO: 2193 - protein, 5 aa, Human severe acute respiratory syndrome virus
LLVLQ

SEQ ID NO: 2194 - protein, 16 aa, Human severe acute respiratory syndrome virus
LPVLYQCVYTTSSHSW

SEQ ID NO: 2195 - protein, 13 aa, Human severe acute respiratory syndrome virus
LVVLHLLGNPYML

SEQ ID NO: 2196 - protein, 19 aa, Human severe acute respiratory syndrome virus
QGLLQKHRRKAQLNWQVLL

SEQ ID NO: 2197 - protein, 8 aa, Human severe acute respiratory syndrome virus
HFQPEDVL

SEQ ID NO: 2198 - protein, 16 aa, Human severe acute respiratory syndrome virus
QLNCPAPYLYLGCLSL

SEQ ID NO: 2199 - protein, 6 aa, Human severe acute respiratory syndrome virus
STSISL

SEQ ID NO: 2200 - protein, 6 aa, Human severe acute respiratory syndrome virus
ALLVCL

SEQ ID NO: 2201 - protein, 18 aa, Human severe acute respiratory syndrome virus
QTYKVVPVLCKLYLYHHS

SEQ ID NO: 2202 - protein, 53 aa, Human severe acute respiratory syndrome virus
DLGGLIVMPAQTYLPSNCYSRQVHCHQYKLFVWYQPHRTSVVVLLDSVHYSVV

SEQ ID NO: 2203 - protein, 8 aa, Human severe acute respiratory syndrome virus
QLSWLLEL

SEQ ID NO: 2204 - protein, 11 aa, Human severe acute respiratory syndrome virus
EAKPNLVNCPC

SEQ ID NO: 2205 - protein, 21 aa, Human severe acute respiratory syndrome virus
VEQSCYPHQQLAGFPRVQMHM

SEQ ID NO: 2206 - protein, 18 aa, Human severe acute respiratory syndrome virus
RCYHHKCSCRYHNQGQQP

SEQ ID NO: 2207 - protein, 4 aa, Human severe acute respiratory syndrome virus
VWLL

SEQ ID NO: 2208 - protein, 9 aa, Human severe acute respiratory syndrome virus
VEHNHHAHC

SEQ ID NO: 2209 - protein, 7 aa, Human severe acute respiratory syndrome virus
VHHYQAS

SEQ ID NO: 2210 - protein, 5 aa, Human severe acute respiratory syndrome virus
RALFA

SEQ ID NO: 2211 - protein, 17 aa, Human severe acute respiratory syndrome virus
LLLPSCPQILPVCTFGS

SEQ ID NO: 2212 - protein, 20 aa, Human severe acute respiratory syndrome virus
PDLPSFPTCVAWQHHGQTQI

SEQ ID NO: 2213 - protein, 9 aa, Human severe acute respiratory syndrome virus
PHSKISLTF

SEQ ID NO: 2214 - protein, 7 aa, Human severe acute respiratory syndrome virus
ERLQNHH

SEQ ID NO: 2215 - protein, 20 aa, Human severe acute respiratory syndrome virus
LQPAHRPPGQWHKRHMMVKN

SEQ ID NO: 2216 - protein, 4 aa, Human severe acute respiratory syndrome virus
ILKQ

SEQ ID NO: 2217 - protein, 11 aa, Human severe acute respiratory syndrome virus
HGYRAFPRTTY

SEQ ID NO: 2218 - protein, 41 aa, Human severe acute respiratory syndrome virus
CLQHPAWIAKQTKEKPSSRKLQLCLLQEEYHCGVVHIVPTI

SEQ ID NO: 2219 - protein, 5 aa, Human severe acute respiratory syndrome virus
KMTLL

SEQ ID NO: 2220 - protein, 18 aa, Human severe acute respiratory syndrome virus
VVEEPRAVPQMCTLRQTF

SEQ ID NO: 2221 - protein, 10 aa, Human severe acute respiratory syndrome virus
YMVYLQYPTT

SEQ ID NO: 2222 - protein, 6 aa, Human severe acute respiratory syndrome virus
KHQYYS

SEQ ID NO: 2223 - protein, 10 aa, Human severe acute respiratory syndrome virus
EAKAPGSSYT

SEQ ID NO: 2224 - protein, 9 aa, Human severe acute respiratory syndrome virus
RPSSHKHQE

SEQ ID NO: 2225 - protein, 20 aa, Human severe acute respiratory syndrome virus
VNRKGQSSSSNNSLRNNKQA

SEQ ID NO: 2226 - protein, 7 aa, Human severe acute respiratory syndrome virus
YTVRCCQ

SEQ ID NO: 2227 - protein, 12 aa, Human severe acute respiratory syndrome virus
ITMGNTQHTQTL

SEQ ID NO: 2228 - protein, 5 aa, Human severe acute respiratory syndrome virus
RHQNS

SEQ ID NO: 2229 - protein, 4 aa, Human severe acute respiratory syndrome virus
RLQK

SEQ ID NO: 2230 - protein, 6 aa, Human severe acute respiratory syndrome virus
LRPTWK

SEQ ID NO: 2231 - protein, 14 aa, Human severe acute respiratory syndrome virus
LDLKHYHSRLCKQV

SEQ ID NO: 2232 - protein, 8 aa, Human severe acute respiratory syndrome virus
HSSVSKHV

SEQ ID NO: 2233 - protein, 10 aa, Human severe acute respiratory syndrome virus
QHHHKQCELS

SEQ ID NO: 2234 - protein, 8 aa, Human severe acute respiratory syndrome virus
AKLKLKHT

SEQ ID NO: 2235 - protein, 6 aa, Human severe acute respiratory syndrome virus
AYNQTS

SEQ ID NO: 2236 - protein, 8 aa, Human severe acute respiratory syndrome virus
CQPIQAMS

SEQ ID NO: 2237 - protein, 5 aa, Human severe acute respiratory syndrome virus
YASPS

SEQ ID NO: 2238 - protein, 6 aa, Human severe acute respiratory syndrome virus
QACRPY

SEQ ID NO: 2239 - protein, 20 aa, Human severe acute respiratory syndrome virus
SKQLLQEKVTETSTRMRAYA

SEQ ID NO: 2240 - protein, 6 aa, Human severe acute respiratory syndrome virus
HMQQLP

SEQ ID NO: 2241 - protein, 37 aa, Human severe acute respiratory syndrome virus
MARKHSRKQRKTVTTVYFEQESIVMSRKLKASNDECP

SEQ ID NO: 2242 - protein, 5 aa, Human severe acute respiratory syndrome virus
TYLGR

SEQ ID NO: 2243 - protein, 5 aa, Human severe acute respiratory syndrome virus
HQSIV

SEQ ID NO: 2244 - protein, 5 aa, Human severe acute respiratory syndrome virus
QHQMV

SEQ ID NO: 2245 - protein, 5 aa, Human severe acute respiratory syndrome virus
THLLK

SEQ ID NO: 2246 - protein, 4 aa, Human severe acute respiratory syndrome virus
CYQG

SEQ ID NO: 2247 - protein, 49 aa, Human severe acute respiratory syndrome virus
YDHSYHSAAALSKQHTYLRRQFLFEQKEVPICQHDLVSKVHSCTSLPQG

SEQ ID NO: 2248 - protein, 4 aa, Human severe acute respiratory syndrome virus
SHSK

SEQ ID NO: 2249 - protein, 6 aa, Human severe acute respiratory syndrome virus
ETTYHH

SEQ ID NO: 2250 - protein, 61 aa, Human severe acute respiratory syndrome virus
QQHTAMPKHLMLWLCLYLQPVQFVCQQMDHRIYLLSQYQRVLLLEAPYDAYSRKTRNHNQC

SEQ ID NO: 2251 - protein, 8 aa, Human severe acute respiratory syndrome virus
NQHYHMIH

SEQ ID NO: 2252 - protein, 4 aa, Human severe acute respiratory syndrome virus
GKNL

SEQ ID NO: 2253 - protein, 35 aa, Human severe acute respiratory syndrome virus
VSWHTDKHQMVNHCSMLELKMFDQVGYGQIYTWVS

SEQ ID NO: 2254 - protein, 4 aa, Human severe acute respiratory syndrome virus
KYQL

SEQ ID NO: 2255 - protein, 5 aa, Human severe acute respiratory syndrome virus
ADNFA

SEQ ID NO: 2256 - protein, 18 aa, Human severe acute respiratory syndrome virus
HEVEHCQPEQESYGWICE

SEQ ID NO: 2257 - protein, 5 aa, Human severe acute respiratory syndrome virus
ADLHS

SEQ ID NO: 2258 - protein, 7 aa, Human severe acute respiratory syndrome virus
ACLLLCK

SEQ ID NO: 2259 - protein, 14 aa, Human severe acute respiratory syndrome virus
HVLDSILCHPTTIH

SEQ ID NO: 2260 - protein, 20 aa, Human severe acute respiratory syndrome virus
FHRLLVPCTLQLCLTGMPFS

SEQ ID NO: 2261 - protein, 8 aa, Human severe acute respiratory syndrome virus
NHSAEQQK

SEQ ID NO: 2262 - protein, 15 aa, Human severe acute respiratory syndrome virus
LMSVVVGREHQHLSC

SEQ ID NO: 2263 - protein, 17 aa, Human severe acute respiratory syndrome virus
SHLEPLLSGSKLLHDSW

SEQ ID NO: 2264 - protein, 5 aa, Human severe acute respiratory syndrome virus
YLRLH

SEQ ID NO: 2265 - protein, 15 aa, Human severe acute respiratory syndrome virus
NTCTCYIEQDTCYTV

SEQ ID NO: 2266 - protein, 15 aa, Human severe acute respiratory syndrome virus
VATVSRYAILGTFPC

SEQ ID NO: 2267 - protein, 12 aa, Human severe acute respiratory syndrome virus
AKRYTKQPPRRY

SEQ ID NO: 2268 - protein, 22 aa, Human severe acute respiratory syndrome virus
RTNGSASEKYRIHRLLLSKKAQ

SEQ ID NO: 2269 - protein, 17 aa, Human severe acute respiratory syndrome virus
EKTWQTIEGEPRMKHHW

SEQ ID NO: 2270 - protein, 25 aa, Human severe acute respiratory syndrome virus
NRMSSTSKRLSRLPAESCKLVPDRV

SEQ ID NO: 2271 - protein, 8 aa, Human severe acute respiratory syndrome virus
KTSKTKVH

SEQ ID NO: 2272 - protein, 12 aa, Human severe acute respiratory syndrome virus
QQQHGCTHQKHV

SEQ ID NO: 2273 - protein, 11 aa, Human severe acute respiratory syndrome virus
SSRQHKSPIWQ

SEQ ID NO: 2274 - protein, 20 aa, Human severe acute respiratory syndrome virus
YHQPLLKQTHLKHPQVAQEE

SEQ ID NO: 2275 - protein, 19 aa, Human severe acute respiratory syndrome virus
DSSHQHHRKLLIELCNAHY

SEQ ID NO: 2276 - protein, 6 aa, Human severe acute respiratory syndrome virus
EPIYHW

SEQ ID NO: 2277 - protein, 25 aa, Human severe acute respiratory syndrome virus
IGKYLLLTFRMYHVYSTQHQKLLLL

SEQ ID NO: 2278 - protein, 7 aa, Human severe acute respiratory syndrome virus
QNPPGKC

SEQ ID NO: 2279 - protein, 4 aa, Human severe acute respiratory syndrome virus
WNHP

SEQ ID NO: 2280 - protein, 13 aa, Human severe acute respiratory syndrome virus
AHNECLDEAHYKK

SEQ ID NO: 2281 - protein, 5 aa, Human severe acute respiratory syndrome virus
NPLAN

SEQ ID NO: 2282 - protein, 10 aa, Human severe acute respiratory syndrome virus
CHNNMAQVCP

SEQ ID NO: 2283 - protein, 12 aa, Human severe acute respiratory syndrome virus
KLYTQQQERKQR

SEQ ID NO: 2284 - protein, 6 aa, Human severe acute respiratory syndrome virus
QNHYTQ

SEQ ID NO: 2285 - protein, 12 aa, Human severe acute respiratory syndrome virus
VWKVCSKCCQQH

SEQ ID NO: 2286 - protein, 11 aa, Human severe acute respiratory syndrome virus
KHEVENARSHH

SEQ ID NO: 2287 - protein, 12 aa, Human severe acute respiratory syndrome virus
LLSAQYPVSQAL

SEQ ID NO: 2288 - protein, 5 aa, Human severe acute respiratory syndrome virus
NQSLL

SEQ ID NO: 2289 - protein, 17 aa, Human severe acute respiratory syndrome virus
QLLQGSFCHFCMNHHAG

SEQ ID NO: 2290 - protein, 15 aa, Human severe acute respiratory syndrome virus
TMRQNQHVYLQNNHQ

SEQ ID NO: 2291 - protein, 9 aa, Human severe acute respiratory syndrome virus
HHPEWLCNQ

SEQ ID NO: 2292 - protein, 15 aa, Human severe acute respiratory syndrome virus
FHLCNHHGLTMYVLA

SEQ ID NO: 2293 - protein, 15 aa, Human severe acute respiratory syndrome virus
RYNKPMQQERTIMWP

SEQ ID NO: 2294 - protein, 5 aa, Human severe acute respiratory syndrome virus
QSYHP

SEQ ID NO: 2295 - protein, 4 aa, Human severe acute respiratory syndrome virus
HKLV

SEQ ID NO: 2296 - protein, 28 aa, Human severe acute respiratory syndrome virus
KVCCSSWQHYEFVYAAVQIKTCSLLHSR

SEQ ID NO: 2297 - protein, 11 aa, Human severe acute respiratory syndrome virus
VKHCDFLLLGH

SEQ ID NO: 2298 - protein, 23 aa, Human severe acute respiratory syndrome virus
YALHYSQYMRQDLWASCFQPYYR

SEQ ID NO: 2299 - protein, 17 aa, Human severe acute respiratory syndrome virus
NCYNCHLSLLSQSDVKV

SEQ ID NO: 2300 - protein, 19 aa, Human severe acute respiratory syndrome virus
HPLCQHRYQQHLVGQLTRM

SEQ ID NO: 2301 - protein, 16 aa, Human severe acute respiratory syndrome virus
KGHHLKLHPLLTRCEL

SEQ ID NO: 2302 - protein, 4 aa, Human severe acute respiratory syndrome virus
QQVP

SEQ ID NO: 2303 - protein, 13 aa, Human severe acute respiratory syndrome virus
KLLKRCRHKHQTS

SEQ ID NO: 2304 - protein, 19 aa, Human severe acute respiratory syndrome virus
RKLQYYLQRLIQELGQATE

SEQ ID NO: 2305 - protein, 13 aa, Human severe acute respiratory syndrome virus
VGTSADCSTQKQT

SEQ ID NO: 2306 - protein, 13 aa, Human severe acute respiratory syndrome virus
KQTRRIWTCHQKL

SEQ ID NO: 2307 - protein, 4 aa, Human severe acute respiratory syndrome virus
AVNL

SEQ ID NO: 2308 - protein, 6 aa, Human severe acute respiratory syndrome virus
LSNCLN

SEQ ID NO: 2309 - protein, 38 aa, Human severe acute respiratory syndrome virus
QNGREDVSHRSFDQPCQSRGEARHFSQQHYQQYTMTGQ

SEQ ID NO: 2310 - protein, 11 aa, Human severe acute respiratory syndrome virus
TGVTNHEQLHH

SEQ ID NO: 2311 - protein, 10 aa, Human severe acute respiratory syndrome virus
MYYQCKMCHN

SEQ ID NO: 2312 - protein, 25 aa, Human severe acute respiratory syndrome virus
DNSNCESCRSHGLHLHRHRKISSCH

SEQ ID NO: 2313 - protein, 24 aa, Human severe acute respiratory syndrome virus
LYTQRVWHDCAYSTSCKSKRCNHP

SEQ ID NO: 2314 - protein, 18 aa, Human severe acute respiratory syndrome virus
YEHSSSICSRKKQRRCTS

SEQ ID NO: 2315 - protein, 11 aa, Human severe acute respiratory syndrome virus
PLQKRVPFVQY

SEQ ID NO: 2316 - protein, 4 aa, Human severe acute respiratory syndrome virus
AKNC

SEQ ID NO: 2317 - protein, 9 aa, Human severe acute respiratory syndrome virus
QNSQRTPAL

SEQ ID NO: 2318 - protein, 10 aa, Human severe acute respiratory syndrome virus
LKDLINKRIL

SEQ ID NO: 2319 - protein, 55 aa, Human severe acute respiratory syndrome virus
TTYMPKPTQRPDLKLSSLACTMKSSPEWFQELDKNQGSLIHLNKCCKEKNLHRNP

SEQ ID NO: 2320 - protein, 4 aa, Human severe acute respiratory syndrome virus
DTIL

SEQ ID NO: 2321 - protein, 10 aa, Human severe acute respiratory syndrome virus
RHYNKKEHQN

SEQ ID NO: 2322 - protein, 24 aa, Human severe acute respiratory syndrome virus
IRVHQKQQLHRLENLSKYLTTIAT

SEQ ID NO: 2323 - protein, 8 aa, Human severe acute respiratory syndrome virus
KIWVTSHN

SEQ ID NO: 2324 - protein, 7 aa, Human severe acute respiratory syndrome virus
CRHPNII

SEQ ID NO: 2325 - protein, 4 aa, Human severe acute respiratory syndrome virus
VVKL

SEQ ID NO: 2326 - protein, 4 aa, Human severe acute respiratory syndrome virus
NWYF

SEQ ID NO: 2327 - protein, 8 aa, Human severe acute respiratory syndrome virus
KYTIGTIM

SEQ ID NO: 2328 - protein, 7 aa, Human severe acute respiratory syndrome virus
THKAYNC

SEQ ID NO: 2329 - protein, 7 aa, Human severe acute respiratory syndrome virus
THVVLIS

SEQ ID NO: 2330 - protein, 5 aa, Human severe acute respiratory syndrome virus
RNLML

SEQ ID NO: 2331 - protein, 8 aa, Human severe acute respiratory syndrome virus
LLLVLRMV

SEQ ID NO: 2332 - protein, 11 aa, Human severe acute respiratory syndrome virus
HKPKFYSKEHY

SEQ ID NO: 2333 - protein, 19 aa, Human severe acute respiratory syndrome virus
LQQYHEWQLFLNLRLVKAH

SEQ ID NO: 2334 - protein, 9 aa, Human severe acute respiratory syndrome virus
CLCFPHKQP

SEQ ID NO: 2335 - protein, 10 aa, Human severe acute respiratory syndrome virus
DPHDLTLVLL

SEQ ID NO: 2336 - protein, 6 aa, Human severe acute respiratory syndrome virus
HLHLMV

SEQ ID NO: 2337 - protein, 6 aa, Human severe acute respiratory syndrome virus
HCLQLR

SEQ ID NO: 2338 - protein, 6 aa, Human severe acute respiratory syndrome virus
FSRHTL

SEQ ID NO: 2339 - protein, 5 aa, Human severe acute respiratory syndrome virus
LPSVW

SEQ ID NO: 2340 - protein, 51 aa, Human severe acute respiratory syndrome virus
DFPLLLQRWVVDFHKQDCPFLVCLLLPELQMNLKYLLALYSKDNVNTKCLV

SEQ ID NO: 2341 - protein, 5 aa, Human severe acute respiratory syndrome virus
TLSWL

SEQ ID NO: 2342 - protein, 10 aa, Human severe acute respiratory syndrome virus
CAKQLAYAVI

SEQ ID NO: 2343 - protein, 9 aa, Human severe acute respiratory syndrome virus
NSLNSVYSQ

SEQ ID NO: 2344 - protein, 11 aa, Human severe acute respiratory syndrome virus
PLHRHSSLGRM

SEQ ID NO: 2345 - protein, 9 aa, Human severe acute respiratory syndrome virus
QIALVKLAL

SEQ ID NO: 2346 - protein, 13 aa, Human severe acute respiratory syndrome virus
SLSFDLNHQQILC

SEQ ID NO: 2347 - protein, 16 aa, Human severe acute respiratory syndrome virus
NYQNSHLVMVELVQGL

SEQ ID NO: 2348 - protein, 23 aa, Human severe acute respiratory syndrome virus
AALYSKHYPFYNTHPILVQSLCK

SEQ ID NO: 2349 - protein, 9 aa, Human severe acute respiratory syndrome virus
LHRVYTTQA

SEQ ID NO: 2350 - protein, 20 aa, Human severe acute respiratory syndrome virus
CKMFPCRKHQSLVLCTLTSL

SEQ ID NO: 2351 - protein, 11 aa, Human severe acute respiratory syndrome virus
GELRQYDRGSP

SEQ ID NO: 2352 - protein, 35 aa, Human severe acute respiratory syndrome virus
QLYECNDHTDSYQCTHSHIRMYLAVIYTQQVVQTS

SEQ ID NO: 2353 - protein, 11 aa, Human severe acute respiratory syndrome virus
QKKTLVVLDIV

SEQ ID NO: 2354 - protein, 13 aa, Human severe acute respiratory syndrome virus
HHDHTHMEWKHLS

SEQ ID NO: 2355 - protein, 18 aa, Human severe acute respiratory syndrome virus
DYHKIEYPYTSQLLHPLR

SEQ ID NO: 2356 - protein, 10 aa, Human severe acute respiratory syndrome virus
FSDHNVYTPH

SEQ ID NO: 2357 - protein, 8 aa, Human severe acute respiratory syndrome virus
ELALQIPN

SEQ ID NO: 2358 - protein, 7 aa, Human severe acute respiratory syndrome virus
HAVEDGS

SEQ ID NO: 2359 - protein, 14 aa, Human severe acute respiratory syndrome virus
HHQARQQFYYCKRV

SEQ ID NO: 2360 - protein, 4 aa, Human severe acute respiratory syndrome virus
VHKS

SEQ ID NO: 2361 - protein, 17 aa, Human severe acute respiratory syndrome virus
QHHQHGLYNKPLEVLVH

SEQ ID NO: 2362 - protein, 10 aa, Human severe acute respiratory syndrome virus
LQAVEVLIKH

SEQ ID NO: 2363 - protein, 9 aa, Human severe acute respiratory syndrome virus
TNNNCYQPI

SEQ ID NO: 2364 - protein, 44 aa, Human severe acute respiratory syndrome virus
LKLNHQLEEISISLCGLKQTCTYQENSHQEYGSTRKLHYVVCHH

SEQ ID NO: 2365 - protein, 14 aa, Human severe acute respiratory syndrome virus
VVQRKSYPHDLHEV

SEQ ID NO: 2366 - protein, 16 aa, Human severe acute respiratory syndrome virus
HQHHPSMLDQTAVHMS

SEQ ID NO: 2367 - protein, 9 aa, Human severe acute respiratory syndrome virus
TYPQAVCGD

SEQ ID NO: 2368 - protein, 5 aa, Human severe acute respiratory syndrome virus
CCPQL

SEQ ID NO: 2369 - protein, 37 aa, Human severe acute respiratory syndrome virus
PPAGIRDSLVCQVKEPHRQDETRRGSPECGTQFCHHA

SEQ ID NO: 2370 - protein, 37 aa, Human severe acute respiratory syndrome virus
EIQHLTLYAVLNRTNLCKSQPKKLFLQSAPQMSLMTK

SEQ ID NO: 2371 - protein, 5 aa, Human severe acute respiratory syndrome virus
GIHYM

SEQ ID NO: 2372 - protein, 13 aa, Human severe acute respiratory syndrome virus
QHLVMILTLRQEL

SEQ ID NO: 2373 - protein, 11 aa, Human severe acute respiratory syndrome virus
ENAYSAQPLQD

SEQ ID NO: 2374 - protein, 10 aa, Human severe acute respiratory syndrome virus
NHVSHNQLAL

SEQ ID NO: 2375 - protein, 10 aa, Human severe acute respiratory syndrome virus
QAAHLESSAS

SEQ ID NO: 2376 - protein, 6 aa, Human severe acute respiratory syndrome virus
KLQALY

SEQ ID NO: 2377 - protein, 16 aa, Human severe acute respiratory syndrome virus
YKRRIGHHSQRCPLEF

SEQ ID NO: 2378 - protein, 13 aa, Human severe acute respiratory syndrome virus
FLYTYVGWLPLWL

SEQ ID NO: 2379 - protein, 4 aa, Human severe acute respiratory syndrome virus
HPCI

SEQ ID NO: 2380 - protein, 26 aa, Human severe acute respiratory syndrome virus
ALIFLSLQHEQAFLSNSRIQFLESLP

SEQ ID NO: 2381 - protein, 14 aa, Human severe acute respiratory syndrome virus
VLLKVVHKMQICIS

SEQ ID NO: 2382 - protein, 32 aa, Human severe acute respiratory syndrome virus
LPQVYNQHILVQGTWLYTHQLALSSKLLRASQ

SEQ ID NO: 2383 - protein, 12 aa, Human severe acute respiratory syndrome virus
CHQPFWRVLQHK

SEQ ID NO: 2384 - protein, 18 aa, Human severe acute respiratory syndrome virus
HHLPCKVHPSQGKTYLHL

SEQ ID NO: 2385 - protein, 11 aa, Human severe acute respiratory syndrome virus
ACSENHGKAYH

SEQ ID NO: 2386 - protein, 9 aa, Human severe acute respiratory syndrome virus
YQQTRVTYW

SEQ ID NO: 2387 - protein, 6 aa, Human severe acute respiratory syndrome virus
FLPVLW

SEQ ID NO: 2388 - protein, 6 aa, Human severe acute respiratory syndrome virus
PHQCRP

SEQ ID NO: 2389 - protein, 28 aa, Human severe acute respiratory syndrome virus
FLASHRQASVRQISPQFWNLLCLVAPLV

SEQ ID NO: 2390 - protein, 4 aa, Human severe acute respiratory syndrome virus
VLPL

SEQ ID NO: 2391 - protein, 8 aa, Human severe acute respiratory syndrome virus
ASGYQDNP

SEQ ID NO: 2392 - protein, 9 aa, Human severe acute respiratory syndrome virus
QPAHKELCH

SEQ ID NO: 2393 - protein, 20 aa, Human severe acute respiratory syndrome virus
LQYKPVYEPSARTLVKTEVV

SEQ ID NO: 2394 - protein, 17 aa, Human severe acute respiratory syndrome virus
HQICLLTTMVQVRCPVN

SEQ ID NO: 2395 - protein, 6 aa, Human severe acute respiratory syndrome virus
NFHMLP

SEQ ID NO: 2396 - protein, 10 aa, Human severe acute respiratory syndrome virus
EAGCPHLHLG

SEQ ID NO: 2397 - protein, 8 aa, Human severe acute respiratory syndrome virus
VQQHADTS

SEQ ID NO: 2398 - protein, 13 aa, Human severe acute respiratory syndrome virus
QDYVQKANKTLLL

SEQ ID NO: 2399 - protein, 5 aa, Human severe acute respiratory syndrome virus
EGHLA

SEQ ID NO: 2400 - protein, 15 aa, Human severe acute respiratory syndrome virus
CNHHSPFAWHHWLPC

SEQ ID NO: 2401 - protein, 13 aa, Human severe acute respiratory syndrome virus
VHLLHHHHVSGVC

SEQ ID NO: 2402 - protein, 6 aa, Human severe acute respiratory syndrome virus
QHLQSP

SEQ ID NO: 2403 - protein, 5 aa, Human severe acute respiratory syndrome virus
HFVPP

SEQ ID NO: 2404 - protein, 5 aa, Human severe acute respiratory syndrome virus
RCQHI

SEQ ID NO: 2405 - protein, 5 aa, Human severe acute respiratory syndrome virus
WQHCQ

SEQ ID NO: 2406 - protein, 5 aa, Human severe acute respiratory syndrome virus
VLNNQ

SEQ ID NO: 2407 - protein, 5 aa, Human severe acute respiratory syndrome virus
LVLQV

SEQ ID NO: 2408 - protein, 11 aa, Human severe acute respiratory syndrome virus
VLVLAQSLIAQ

SEQ ID NO: 2409 - protein, 80 aa, Human severe acute respiratory syndrome virus
YHPASLPLLLPQLELFQLRHQIPEGDLDNHPLYRTHVHRFHQFLLPHTLHRPLLPHLEGKRNNTYVMKSFLHQHHQISRM

SEQ ID NO: 2410 - protein, 12 aa, Human severe acute respiratory syndrome virus
LHSTHQDQYPCW

SEQ ID NO: 2411 - protein, 21 aa, Human severe acute respiratory syndrome virus
GDQKLVVKSSQQPLLQHMQTQ

SEQ ID NO: 2412 - protein, 14 aa, Human severe acute respiratory syndrome virus
LRYRIQQCRQSTFH

SEQ ID NO: 2413 - protein, 11 aa, Human severe acute respiratory syndrome virus
ALCQHVHQAQM

SEQ ID NO: 2414 - protein, 20 aa, Human severe acute respiratory syndrome virus
FSHSCNLELPKQYLLQRLHL

SEQ ID NO: 2415 - protein, 12 aa, Human severe acute respiratory syndrome virus
LVHPLLSERHCL

SEQ ID NO: 2416 - protein, 14 aa, Human severe acute respiratory syndrome virus
PVNQETMRSIVLCP

SEQ ID NO: 2417 - protein, 4 aa, Human severe acute respiratory syndrome virus
SLRA

SEQ ID NO: 2418 - protein, 10 aa, Human severe acute respiratory syndrome virus
GHLHRLVCQR

SEQ ID NO: 2419 - protein, 14 aa, Human severe acute respiratory syndrome virus
SYQRASRVLRVHRS

SEQ ID NO: 2420 - protein, 6 aa, Human severe acute respiratory syndrome virus
EQPPQR

SEQ ID NO: 2421 - protein, 17 aa, Human severe acute respiratory syndrome virus
VLCHVNHLQERLLLLVP

SEQ ID NO: 2422 - protein, 20 aa, Human severe acute respiratory syndrome virus
VVAAAPCHVYTDGKVPCFER

SEQ ID NO: 2423 - protein, 5 aa, Human severe acute respiratory syndrome virus
RLHLS

SEQ ID NO: 2424 - protein, 8 aa, Human severe acute respiratory syndrome virus
VIATLRQR

SEQ ID NO: 2425 - protein, 10 aa, Human severe acute respiratory syndrome virus
LDQCTFRVPC

SEQ ID NO: 2426 - protein, 6 aa, Human severe acute respiratory syndrome virus
SILHNP

SEQ ID NO: 2427 - protein, 10 aa, Human severe acute respiratory syndrome virus
CYLKQPVFDP

SEQ ID NO: 2428 - protein, 6 aa, Human severe acute respiratory syndrome virus
RCQKHL

SEQ ID NO: 2429 - protein, 6 aa, Human severe acute respiratory syndrome virus
ESPKHP

SEQ ID NO: 2430 - protein, 6 aa, Human severe acute respiratory syndrome virus
EIQLLH

SEQ ID NO: 2431 - protein, 8 aa, Human severe acute respiratory syndrome virus
VSPQSIQR

SEQ ID NO: 2432 - protein, 4 aa, Human severe acute respiratory syndrome virus
VFQQ

SEQ ID NO: 2433 - protein, 4 aa, Human severe acute respiratory syndrome virus
CPKD

SEQ ID NO: 2434 - protein, 16 aa, Human severe acute respiratory syndrome virus
TTTEKSVVQDHQLHMP

SEQ ID NO: 2435 - protein, 23 aa, Human severe acute respiratory syndrome virus
AGLKYKPWRRQDVMTVQKYHQVW

SEQ ID NO: 2436 - protein, 22 aa, Human severe acute respiratory syndrome virus
QLLFANQELSGLLHQVCAQKLI

SEQ ID NO: 2437 - protein, 31 aa, Human severe acute respiratory syndrome virus
HQQPVRENHTVVLKLISVVQCSKHLLRAFPW

SEQ ID NO: 2438 - protein, 11 aa, Human severe acute respiratory syndrome virus
LYSYRRTQQWF

SEQ ID NO: 2439 - protein, 8 aa, Human severe acute respiratory syndrome virus
KTCNQDSL

SEQ ID NO: 2440 - protein, 7 aa, Human severe acute respiratory syndrome virus
KQRKMPK

SEQ ID NO: 2441 - protein, 13 aa, Human severe acute respiratory syndrome virus
WQPLHSNENRQQC

SEQ ID NO: 2442 - protein, 20 aa, Human severe acute respiratory syndrome virus
HVHDSVSQGDPHSRSPHCHQ

SEQ ID NO: 2443 - protein, 10 aa, Human severe acute respiratory syndrome virus
CQYGLSQYQH

SEQ ID NO: 2444 - protein, 23 aa, Human severe acute respiratory syndrome virus
HEEPSRHAYYSSQHRQTHSLQNI

SEQ ID NO: 2445 - protein, 40 aa, Human severe acute respiratory syndrome virus
SYLPCGVEFQCLSGCDNLQHYAQVQSLGLDRQDMAFSLQH

SEQ ID NO: 2446 - protein, 5 aa, Human severe acute respiratory syndrome virus
VGTHM

SEQ ID NO: 2447 - protein, 31 aa, Human severe acute respiratory syndrome virus
LNFQCHNVHKWLSESRTSAMKLHRNDYISSR

SEQ ID NO: 2448 - protein, 21 aa, Human severe acute respiratory syndrome virus
TSAYCYTPVEMQQGTQSVYAP

SEQ ID NO: 2449 - protein, 12 aa, Human severe acute respiratory syndrome virus
NPQSFSFQHVVE

SEQ ID NO: 2450 - protein, 10 aa, Human severe acute respiratory syndrome virus
EETQTLGIPL

SEQ ID NO: 2451 - protein, 8 aa, Human severe acute respiratory syndrome virus
KCQISWHS

SEQ ID NO: 2452 - protein, 15 aa, Human severe acute respiratory syndrome virus
FRRVSGARSSYQSAQ

SEQ ID NO: 2453 - protein, 39 aa, Human severe acute respiratory syndrome virus
TRQFHAHGHGSSRHLSSTRCNQVVRKECTLTCPRVRENL

SEQ ID NO: 2454 - protein, 18 aa, Human severe acute respiratory syndrome virus
CNQEGTHLGHRNCCRHSE

SEQ ID NO: 2455 - protein, 4 aa, Human severe acute respiratory syndrome virus
LHLH

SEQ ID NO: 2456 - protein, 9 aa, Human severe acute respiratory syndrome virus
VHGVHHCHA

SEQ ID NO: 2457 - protein, 91 aa, Human severe acute respiratory syndrome virus
CSSFVHNLQWDQCQARHLSHKTLDRCHSYDHRLPYYRSYEEEHCGMQLGFRPHVARVLPVLYRYDRTECRPFLQPAQRPCGRDWCLRHQNV

SEQ ID NO: 2458 - protein, 23 aa, Human severe acute respiratory syndrome virus
THRAVQAGAVRLFPALLDHKCHF

SEQ ID NO: 2459 - protein, 22 aa, Human severe acute respiratory syndrome virus
GVHVPPIGPLPQSPRSHALARL

SEQ ID NO: 2460 - protein, 6 aa, Human severe acute respiratory syndrome virus
PEGQAN

SEQ ID NO: 2461 - protein, 7 aa, Human severe acute respiratory syndrome virus
VGRVFSR

SEQ ID NO: 2462 - protein, 47 aa, Human severe acute respiratory syndrome virus
HQEQGSPSYLSVTPGRNLGMLMIDCNTDETVSSLQKRDELLVSCQRQ

SEQ ID NO: 2463 - protein, 22 aa, Human severe acute respiratory syndrome virus
NLLLFILRRCTRHAAERQLHRF

SEQ ID NO: 2464 - protein, 19 aa, Human severe acute respiratory syndrome virus
SSFREQIYKRSRLVGFSWV

What is claimed is:

1. An isolated nucleic acid molecule consisting of at least 12 contiguous nucleotides of the nucleotide sequence of SEQ ID NO:1, or the full-length complement thereof.

2. The nucleic acid molecule of claim 1, wherein the molecule is RNA.

3. The nucleic acid molecule of claim 1, wherein the molecule is DNA.

4. A vector consisting of at least 12 contiguous nucleotides of the nucleotide sequence of SEQ ID NO:1 operably linked to one or more control elements.

5. An isolated host cell comprising the vector of claim 4.

\* \* \* \* \*